United States Patent
Fitzgerald et al.

(10) Patent No.: US 10,231,988 B2
(45) Date of Patent: Mar. 19, 2019

(54) PATATIN-LIKE PHOSPHOLIPASE DOMAIN CONTAINING 3 (PNPLA3) IRNA COMPOSITIONS AND METHODS OF USE THEREOF

(71) Applicant: Alnylam Pharmaceuticals, Inc., Cambridge, MA (US)

(72) Inventors: Kevin Fitzgerald, Brookline, MA (US); Gregory Hinkle, Cambridge, MA (US)

(73) Assignee: Alnylam Pharmaceuticals, Inc., Cambridge, MA (US)

( * ) Notice: Subject to any disclaimer, the term of this patent is extended or adjusted under 35 U.S.C. 154(b) by 0 days.

(21) Appl. No.: 15/670,132

(22) Filed: Aug. 7, 2017

(65) Prior Publication Data

US 2017/0340661 A1   Nov. 30, 2017

Related U.S. Application Data

(63) Continuation of application No. PCT/US2016/017550, filed on Feb. 11, 2016.

(60) Provisional application No. 62/266,818, filed on Dec. 14, 2015, provisional application No. 62/115,724, filed on Feb. 13, 2015.

(51) Int. Cl.

| | | |
|---|---|---|
| C07H 21/02 | (2006.01) | |
| C07H 21/04 | (2006.01) | |
| A61K 31/70 | (2006.01) | |
| A61K 31/7125 | (2006.01) | |
| C12N 15/113 | (2010.01) | |
| C12P 19/34 | (2006.01) | |
| C12N 5/00 | (2006.01) | |
| C07H 19/067 | (2006.01) | |
| C07H 19/167 | (2006.01) | |

(52) U.S. Cl.
CPC ......... *A61K 31/7125* (2013.01); *C07H 21/02* (2013.01); *C12N 15/113* (2013.01); *C12N 15/1137* (2013.01); *C12P 19/34* (2013.01); *C07H 19/067* (2013.01); *C07H 19/167* (2013.01); *C12N 2310/14* (2013.01); *C12N 2310/321* (2013.01); *C12N 2310/322* (2013.01); *C12N 2310/3515* (2013.01)

(58) Field of Classification Search
None
See application file for complete search history.

(56) References Cited

U.S. PATENT DOCUMENTS

| | | |
|---|---|---|
| 9,399,775 B2 | 7/2016 | Rajeev et al. |
| 9,796,974 B2 | 10/2017 | Rajeev et al. |
| 2018/0008724 A1 | 1/2018 | Rajeev et al. |
| 2018/0201936 A1 | 7/2018 | Hinkle |

FOREIGN PATENT DOCUMENTS

WO   WO-2004048511 A2   6/2004

OTHER PUBLICATIONS

Kumashiro et al. "Role of patatin-like phospholipase domain-containing 3 on lipid-induced hepatic steatosis and insulin resistance in rats," Hepatology, vol. 57, No. 5, 2013.
Hao et al., "Shifts in dietary carbohydrate-lipid exposure regulate expression of the non-alcoholic fatty liver disease-associated gene PNPLA3/adiponutrin in mouse liver and HepG2 human liver cells," Metabolism—Clinical and Experimental (2014), vol. 63, Issue 10, 1352-1362.
"GalNAc-siRNA with Enchanced stabilization chemistry: ESC-GalNAc-siRNA," Retrieved from the Internet: hhtp://www.alnylam.com/web/.../ALNY-ESC-GalNAc-siRNA-TIDES-May2014-Capella.pdf.
International Search Report and Written Opinion from PCT/US2016/017550 dated Aug. 5, 2016.
International Search Report and Written Opinion from PCT/US2016/051252 dated Feb. 6, 2017.
Min et al., "Metabolic profiling reveals that PNPLA3 induces widespread effects on metabolism beyond triacylglycerol remodeling in Huh-7 hepatoma cells," Am J Physiol Gastrointest Liver Physiol. 2014; 307(1):G-66-G76.
Database EMBL [Online] Sep. 12, 2011, "JP 2006507841-A/567366: Functional and Hyperfunctional siRNA.", retrieved from EBI accession No. EM_PAT:GB004957.

*Primary Examiner* — Sean McGarry
(74) *Attorney, Agent, or Firm* — McCarter & English, LLP; Maria Laccotripe Zacharakis; Deborah L. Nagle

(57) ABSTRACT

The present invention relates to RNAi agents, e.g., double stranded RNAi agents, targeting the Patatin-Like Phospholipase Domain Containing 3 (PNPLA3) gene, and methods of using such RNAi agents to inhibit expression of a PNPLA3 gene and methods of treating subjects having Nonalcoholic Fatty Liver Disease (NAFLD) and/or a PNPLA3-associated disorder.

28 Claims, 1 Drawing Sheet
Specification includes a Sequence Listing.

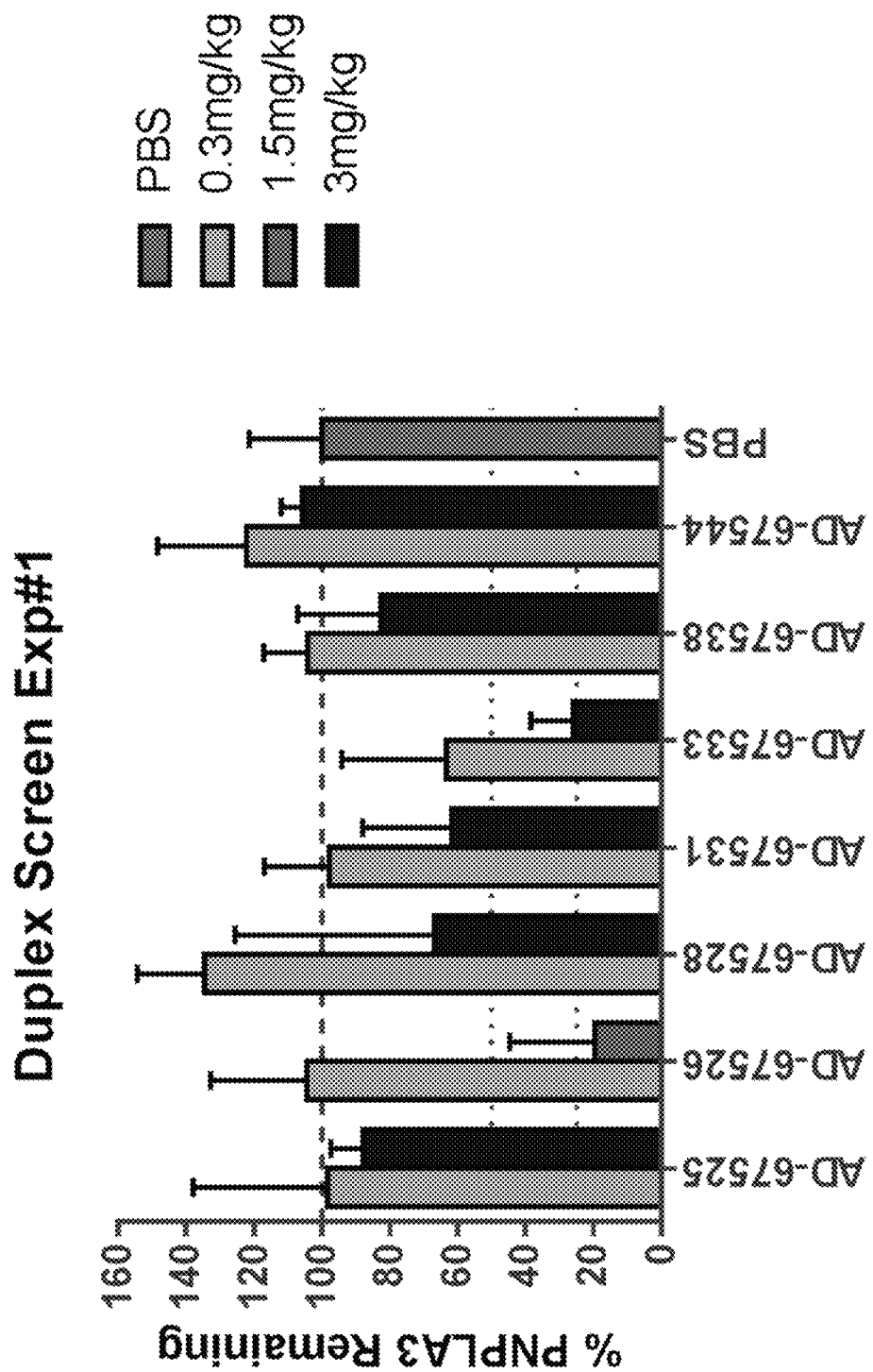

PATATIN-LIKE PHOSPHOLIPASE DOMAIN CONTAINING 3 (PNPLA3) IRNA COMPOSITIONS AND METHODS OF USE THEREOF

RELATED APPLICATIONS

This application is a 35 § U.S.C. 111(a) continuation application which claims the benefit of priority to PCT/US2016/017550, filed on Feb. 11, 2016, to U.S. Provisional Patent Application No. 62/115,724, filed on Feb. 13, 2015, and to U.S. Provisional Patent Application No. 62/266,818, filed on Dec. 14, 2015. The entire contents of each of the foregoing applications are hereby incorporated herein by reference.

SEQUENCE LISTING

The instant application contains a Sequence Listing which has been submitted electronically in ASCII format and is hereby incorporated by reference in its entirety. Said ASCII copy, created on Jul. 27, 2017, is named 121301-03203_SL.txt and is 529,849 bytes in size.

BACKGROUND OF THE INVENTION

The accumulation of excess triglyceride in the liver is known as hepatic steatosis (or fatty liver), and is associated with adverse metabolic consequences, including insulin resistance and dyslipidemia. Fatty liver is frequently found in subjects having excessive alcohol intake and subjects having obesity, diabetes, or hyperlipidemia. However, in the absence of excessive alcohol intake (>10 g/day), nonalcoholic fatty liver disease (NAFLD) can develop. NAFLD refers to a wide spectrum of liver diseases that can progress from simple fatty liver (steatosis), to nonalcoholic steatohepatitis (NASH), to cirrhosis (irreversible, advanced scarring of the liver). All of the stages of NAFLD have in common the accumulation of fat (fatty infiltration) in the liver cells (hepatocytes).

The NAFLD spectrum begins with and progress from its simplest stage, called simple fatty liver (steatosis). Simple fatty liver involves the accumulation of fat (triglyceride) in the liver cells with no inflammation (hepatitis) or scarring (fibrosis). The next stage and degree of severity in the NAFLD spectrum is NASH, which involves the accumulation of fat in the liver cells, as well as inflammation of the liver. The inflammatory cells destroy liver cells (hepatocellular necrosis), and NASH ultimately leads to scarring of the liver (fibrosis), followed by irreversible, advanced scarring (cirrhosis). Cirrhosis that is caused by NASH is the last and most severe stage in the NAFLD spectrum.

In 2008, a genomewide association study of individuals with proton magnetic resonance spectroscopy of the liver to evaluate hepatic fat content, a significant association was identified between hepatic fat content and the Patatin-like Phospholipase Domain Containing 3 (PNPLA3) gene (see, for example, Romeo et al. (2008) *Nat. Genet.*, 40(12):1461-1465). Studies with knock-in mice have demonstrated that expression of a sequence polymorphism (rs738409, I148M) in PNPLA3 causes NAFLD, and that the accumulation of catalytically inactive PNPLA3 on the surfaces of lipid droplets is associated with the accumulation of triglycerides in the liver (Smagris et al. (2015) *Hepatology*, 61:108-118). Specifically, the PNPLA3 I148M variant was associated with promoting the development of fibrogenesis by activating the hedgehog (Hh) signaling pathway, leading to the activation and proliferation of hepatic stellate cells and excessive generation and deposition of extracellular matrix (Chen et al. (2015) *World J. Gastroenterol.*, 21(3):794-802).

Currently, treatments for NAFLD are directed towards weight loss and treatment of any secondary conditions, such as insulin resistance or dyslipidemia. To date, no pharmacologic treatments for NAFLD have been approved. Therefore, there is a need for therapies for subjects suffering from NAFLD.

SUMMARY OF THE INVENTION

The present invention provides iRNA compositions which effect the RNA-induced silencing complex (RISC)-mediated cleavage of RNA transcripts of a PNPLA3 gene. The PNPLA3 gene may be within a cell, e.g., a cell within a subject, such as a human.

In one aspect, the invention provides a double stranded ribonucleic acid (RNAi) agent for inhibiting expression of Patatin-Like Phospholipase Domain Containing 3 (PNPLA3), wherein the double stranded RNAi agent comprises a sense strand and an antisense strand, wherein the sense strand comprises at least 15 contiguous nucleotides differing by no more than 3 nucleotides from the nucleotide sequence of SEQ ID NO:1 and the antisense strand comprises at least 15 contiguous nucleotides differing by no more than 3 nucleotides from the nucleotide sequence of SEQ ID NO:2. In one embodiment, the sense and antisense strands comprise sequences selected from the group consisting of any of the sequences in any one of Tables 3-5, 7, and 8.

In another aspect, the invention provides a double stranded ribonucleic acid (RNAi) agent for inhibiting expression of Patatin-Like Phospholipase Domain Containing 3 (PNPLA3), wherein the double stranded RNAi agent comprises a sense strand and an antisense strand, the antisense strand comprising a region of complementarity which comprises at least 15 contiguous nucleotides differing by no more than 3 nucleotides from any one of the antisense sequences listed in any one of Tables 3-5, 7, and 8.

In one embodiment, the double stranded RNAi agent comprises at least one modified nucleotide. In another embodiment, all of the nucleotides of the sense strand and all of the nucleotides of the antisense strand comprise a modification.

In another aspect, the invention provides a double stranded ribonucleic acid (RNAi) agent for inhibiting expression of Patatin-Like Phospholipase Domain Containing 3 (PNPLA3), wherein the double stranded RNAi agent comprises a sense strand and an antisense strand forming a double stranded region, wherein the sense strand comprises at least 15 contiguous nucleotides differing by no more than 3 nucleotides from the nucleotide sequence of SEQ ID NO:1 and the antisense strand comprises at least 15 contiguous nucleotides differing by no more than 3 nucleotides from the nucleotide sequence of SEQ ID NO:2, wherein substantially all of the nucleotides of the sense strand and substantially all of the nucleotides of the antisense strand are modified nucleotides, and wherein the sense strand is conjugated to a ligand attached at the 3'-terminus.

In one embodiment, all of the nucleotides of the sense strand and all of the nucleotides of the antisense strand comprise a modification. In one embodiment, at least one of the modified nucleotides is selected from the group consisting of a deoxy-nucleotide, a 3'-terminal deoxy-thymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxly-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, and a nucleotide comprising a 5'-phosphate mimic. In another embodiment, the modified nucleotides comprise a short sequence of 3'-terminal deoxy-thymine nucleotides (dT).

In one embodiment, the region of complementarity is at least 17 nucleotides in length. In another embodiment, the region of complementarity is between 19 and 21 nucleotides in length. In another embodiment, the region of complementarity is 19 nucleotides in length. In another embodiment, each strand is no more than 30 nucleotides in length.

In one embodiment, at least one strand comprises a 3' overhang of at least 1 nucleotide. In another embodiment, at least one strand comprises a 3' overhang of at least 2 nucleotides.

In one embodiment, the double stranded RNAi agent further comprises a ligand. In one embodiment, the ligand is conjugated to the 3' end of the sense strand of the double stranded RNAi agent. In another embodiment, the ligand is an N-acetylgalactosamine (GalNAc) derivative. In one embodiment, the ligand is

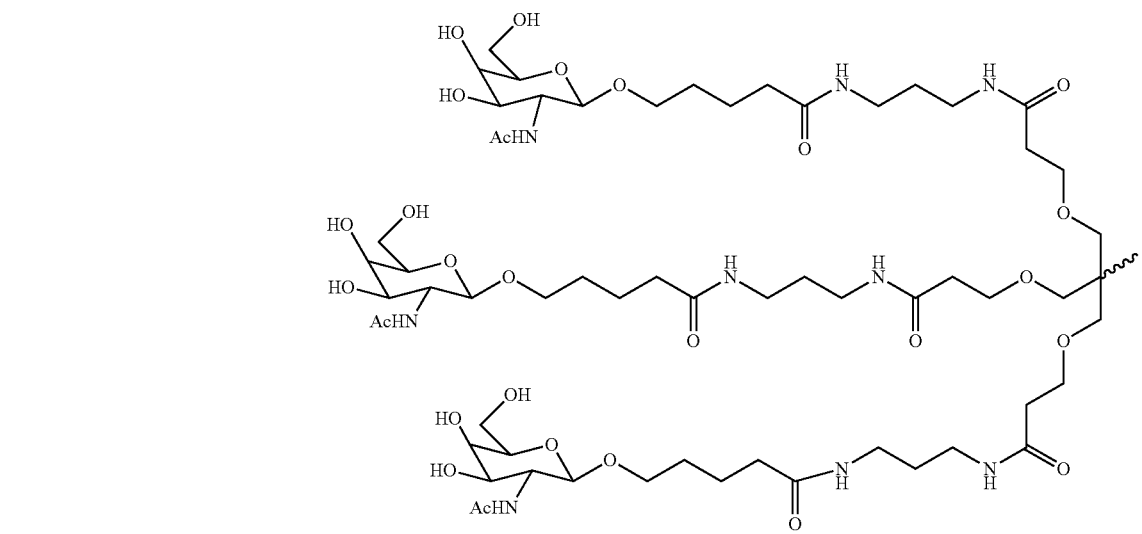

In another embodiment, the double stranded RNAi agent is conjugated to the ligand as shown in the following schematic:

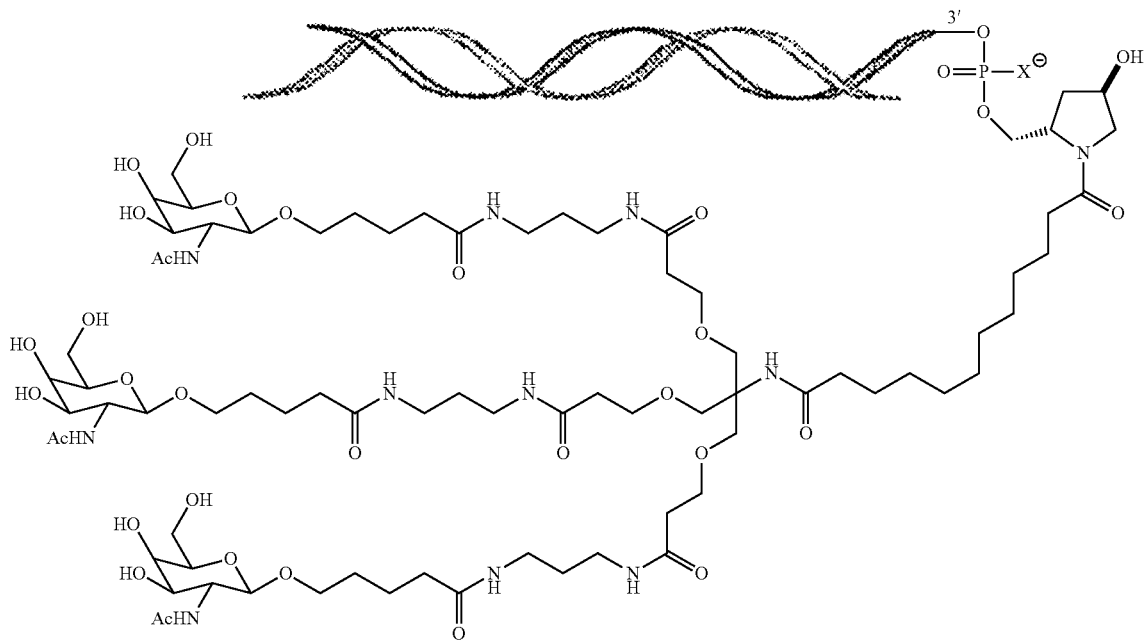

and, wherein X is O or S. In one embodiment, the X is O.

In one embodiment, the region of complementarity comprises one of the antisense sequences in any one of Tables 3-5, 7, and 8. In another embodiment, the region of complementarity consists of one of the antisense sequences in any one of Tables 3-5, 7, and 8.

In another aspect, the invention provides a double stranded ribonucleic acid (RNAi) agent for inhibiting the expression of PNPLA3, wherein the double stranded RNAi agent comprises a sense strand complementary to an antisense strand, wherein the antisense strand comprises a region complementary to part of an mRNA encoding PNPLA3, wherein each strand is about 14 to about 30 nucleotides in length, wherein the double stranded RNAi agent is represented by formula (III):

(III)
sense:
5' $n_p$-$N_a$-(X X X)$_i$-$N_b$-Y Y Y-$N_b$-(Z Z Z)$_j$-$N_a$-$n_q$ 3' antisense:
3' $n_p'$-$N_a'$-(X'X'X')$_k$-$N_b'$-Y'Y'Y'-$N_b'$-(Z'Z'Z')$_l$-$N_a'$-$n_q'$ 5' wherein: i, j, k, and l are each independently 0 or 1; p, p', q, and q' are each independently 0-6; each $N_a$ and $N_a'$ independently represents an oligonucleotide sequence comprising 0-25 nucleotides which are either modified or unmodified or combinations thereof, each sequence comprising at least two differently modified nucleotides; each $N_b$ and $N_b'$ independently represents an oligonucleotide sequence comprising 0-10 nucleotides which are either modified or unmodified or combinations thereof; each $n_p$, $n_p'$, $n_q$, and $n_q'$, each of which may or may not be present, independently represents an overhang nucleotide; XXX, YYY, ZZZ, X'X'X', Y'Y'Y', and Z'Z'Z' each independently represent one motif of three identical modifications on three consecutive nucleotides; modifications on $N_b$ differ from the modification on Y and modifications on $N_b'$ differ from the modification on Y'; and wherein the sense strand is conjugated to at least one ligand.

In one embodiment, i is 0; j is 0; i is 1; j is 1; both i and j are 0; or both i and j are 1. In another embodiment, k is 0; l is 0; k is 1; l is 1; both k and l are 0; or both k and l are 1. In another embodiment, XXX is complementary to X'X'X', YYY is complementary to Y'Y'Y', and ZZZ is complementary to Z'Z'Z'. In another embodiment, the YYY motif occurs at or near the cleavage site of the sense strand. In another embodiment, the Y'Y'Y' motif occurs at the 11, 12 and 13 positions of the antisense strand from the 5'-end. In one embodiment, the Y' is 2'-O-methyl.

In one embodiment, formula (III) is represented by formula (IIIa):

(IIIa)
sense:
5' $n_p$-$N_a$-Y Y Y-$N_a$-$n_q$ 3'.

antisense:
3' $n_p'$-$N_a'$-Y'Y'Y'-$N_a'$-$n_q'$ 5'

In another embodiment, formula (III) is represented by formula (IIIb):

(IIIb)
sense:
5' $n_p$-$N_a$-Y Y Y-$N_b$-Z Z Z-$N_a$-$n_q$ 3' antisense:
3' $n_p'$-$N_a'$-Y'Y'Y'-$N_b'$-Z'Z'Z'-$N_a'$-$n_q'$ 5' wherein each $N_b$ and $N_b'$ independently represents an oligonucleotide sequence comprising 1-5 modified nucleotides.

In another embodiment, formula (III) is represented by formula (IIIc):

(IIIc)
sense:
5' $n_p$-$N_a$-X X X-$N_b$-Y Y Y-$N_a$-$n_q$ 3' antisense:
3' $n_p'$-$N_a'$-X'X'X'-$N_b'$-Y'Y'Y'-$N_a'$-$n_q'$ 5' wherein each $N_b$ and $N_b'$ independently represents an oligonucleotide sequence comprising 1-5 modified nucleotides.

In another embodiment, formula (III) is represented by formula (IIId):

(IIId)
sense:
5' $n_p$-$N_a$-X X X-$N_b$-Y Y Y-$N_b$-Z Z Z-$N_a$-$n_q$ 3' antisense:
3' $n_p'$-$N_a'$-X'X'X'-$N_b'$-Y'Y'Y'-$N_b'$-Z'Z'Z'-$N_a'$-$n_q'$ 5' wherein each $N_b$ and $N_b'$ independently represents an oligonucleotide sequence comprising 1-5 modified nucleotides and each $N_a$ and $N_a'$ independently represents an oligonucleotide sequence comprising 2-10 modified nucleotides.

In one embodiment, the double stranded region is 15-30 nucleotide pairs in length. In another embodiment, the double stranded region is 17-23 nucleotide pairs in length. In another embodiment, the double stranded region is 17-25 nucleotide pairs in length. In another embodiment, the double stranded region is 23-27 nucleotide pairs in length. In another embodiment, the double stranded region is 19-21 nucleotide pairs in length. In another embodiment, the double stranded region is 21-23 nucleotide pairs in length.

In one embodiment, each strand has 15-30 nucleotides. In another embodiment, each strand has 19-30 nucleotides.

In one embodiment, the modifications on the nucleotides are selected from the group consisting of LNA, HNA, CeNA, 2'-methoxyethyl, 2'-O-alkyl, 2'-O-allyl, 2'-C-allyl, 2'-fluoro, 2'-deoxy, 2'-hydroxyl, and combinations thereof. In another embodiment, the modifications on the nucleotides are 2'-O-methyl or 2'-fluoro modifications.

In one embodiment, the ligand is one or more GalNAc derivatives attached through a bivalent or trivalent branched linker. In one embodiment, the ligand is

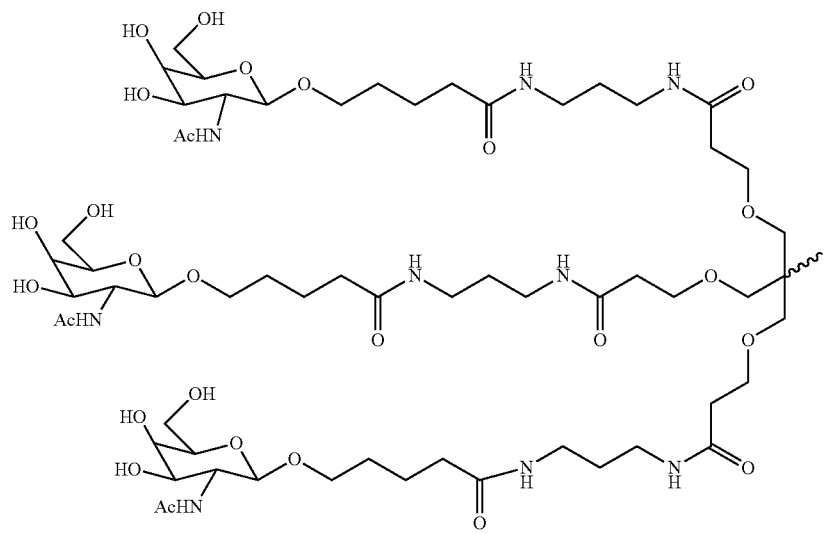

In one embodiment, the ligand is attached to the 3' end of the sense strand.

In one embodiment, the double stranded RNAi agent is conjugated to the ligand as shown in the following schematic In one embodiment, the base pair at the 1 position of the 5'-end of the antisense strand of the duplex is an AU base pair.

In one embodiment, the Y nucleotides contain a 2'-fluoro modification. In another embodiment, the Y' nucleotides

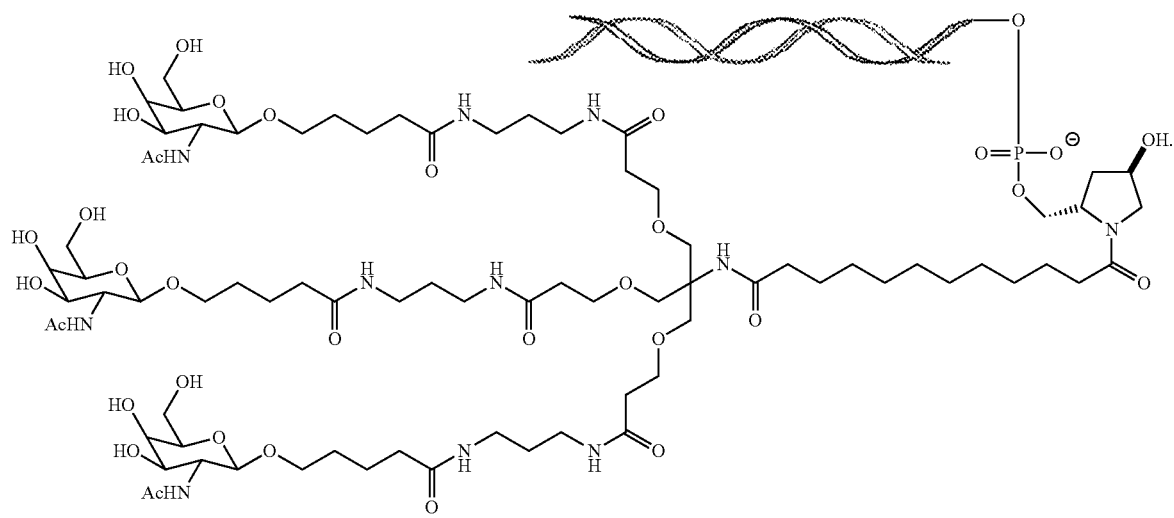

In one embodiment, the double stranded RNAi agent further comprises at least one phosphorothioate or methylphosphonate internucleotide linkage. In one embodiment, the phosphorothioate or methylphosphonate internucleotide linkage is at the 3'-terminus of one strand. In one embodiment, the strand is the antisense strand. In another embodiment, the strand is the sense strand.

In one embodiment, the phosphorothioate or methylphosphonate internucleotide linkage is at the 5'-terminus of one strand. In another embodiment, the strand is the antisense strand. In another embodiment, the strand is the sense strand.

In one embodiment, the phosphorothioate or methylphosphonate internucleotide linkage is at the both the 5'- and 3'-terminus of one strand. In another embodiment, the strand is the antisense strand.

contain a 2'-O-methyl modification. In another embodiment, p'>0. In another embodiment, p'=2. In another embodiment, q'=0, p=0, q=0, and p' overhang nucleotides are complementary to the target mRNA. In another embodiment, q'=0, p=0, q=0, and p' overhang nucleotides are non-complementary to the target mRNA.

In one embodiment, the sense strand has a total of 21 nucleotides and the antisense strand has a total of 23 nucleotides.

In one embodiment, at least one $n_p'$ is linked to a neighboring nucleotide via a phosphorothioate linkage. In another embodiment, all $n_p'$ are linked to neighboring nucleotides via phosphorothioate linkages.

In one embodiment, the double stranded RNAi agent is selected from the group of RNAi agents listed in any one of Tables 3-5, 7, and 8. In another embodiment, all of the nucleotides of the sense strand and all of the nucleotides of the antisense strand comprise a modification.

In another aspect, the invention provides a double stranded ribonucleic acid (RNAi) agent for inhibiting the expression of PNPLA3 in a cell, wherein the double stranded RNAi agent comprises a sense strand complementary to an antisense strand, wherein the antisense strand comprises a region complementary to part of an mRNA encoding PNPLA3, wherein each strand is about 14 to about 30 nucleotides in length, wherein the double stranded RNAi agent is represented by formula (III):

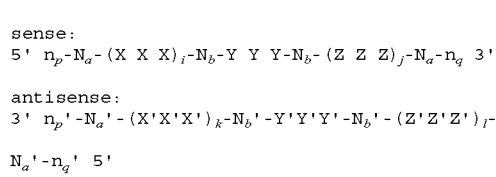

wherein i, j, k, and l are each independently 0 or 1; p, p', q, and q' are each independently 0-6; each $N_a$ and $N_a'$ independently represents an oligonucleotide sequence comprising 0-25 nucleotides which are either modified or unmodified or combinations thereof, each sequence comprising at least two differently modified nucleotides; each $N_b$ and $N_b'$ independently represents an oligonucleotide sequence comprising 0-10 nucleotides which are either modified or unmodified or combinations thereof; each $n_p$, $n_p'$, $n_q$, and $n_q'$, each of which may or may not be present independently represents an overhang nucleotide; XXX, YYY, ZZZ, X'X'X', Y'Y'Y', and Z'Z'Z' each independently represent one motif of three identical modifications on three consecutive nucleotides, and wherein the modifications are 2'-O-methyl or 2'-fluoro modifications; modifications on $N_b$ differ from the modification on Y and modifications on $N_b'$ differ from the modification on Y'; and wherein the sense strand is conjugated to at least one ligand.

In another aspect, the invention provides a double stranded ribonucleic acid (RNAi) agent for inhibiting the expression of PNPLA3 in a cell, wherein the double stranded RNAi agent comprises a sense strand complementary to an antisense strand, wherein the antisense strand comprises a region complementary to part of an mRNA encoding PNPLA3, wherein each strand is about 14 to about 30 nucleotides in length, wherein the double stranded RNAi agent is represented by formula (III):

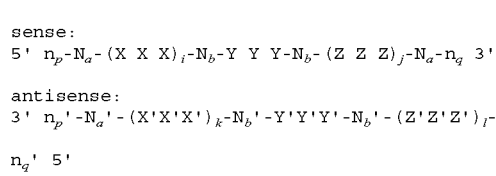

wherein: i, j, k, and l are each independently 0 or 1; each $n_p$, $n_q$, and $n_q'$, each of which may or may not be present, independently represents an overhang nucleotide;

p, q, and q' are each independently 0-6; $n_p'>0$ and at least one $n_p'$ is linked to a neighboring nucleotide via a phosphorothioate linkage; each $N_a$ and $N_a'$ independently represents an oligonucleotide sequence comprising 0-25 nucleotides which are either modified or unmodified or combinations thereof, each sequence comprising at least two differently modified nucleotides; each $N_b$ and $N_b'$ independently represents an oligonucleotide sequence comprising 0-10 nucleotides which are either modified or unmodified or combinations thereof; XXX, YYY, ZZZ, X'X'X', Y'Y'Y', and Z'Z'Z' each independently represent one motif of three identical modifications on three consecutive nucleotides, and wherein the modifications are 2'-O-methyl or 2'-fluoro modifications; modifications on $N_b$ differ from the modification on Y and modifications on $N_b'$ differ from the modification on Y'; and wherein the sense strand is conjugated to at least one ligand.

In another embodiment, the invention provides a double stranded-ribonucleic acid (RNAi) agent for inhibiting the expression of PNPLA3 in a cell, wherein the double stranded RNAi agent comprises a sense strand complementary to an antisense strand, wherein the antisense strand comprises a region complementary to part of an mRNA encoding PNPLA3, wherein each strand is about 14 to about 30 nucleotides in length, wherein the double stranded RNAi agent is represented by formula (III):

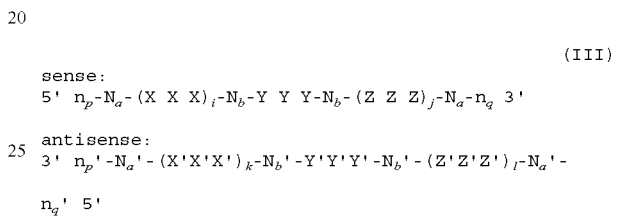

wherein i, j, k, and l are each independently 0 or 1; each $n_p$, $n_q$, and $n_q'$, each of which may or may not be present, independently represents an overhang nucleotide; p, q, and q' are each independently 0-6; $n_p'>0$ and at least one $n_p'$ is linked to a neighboring nucleotide via a phosphorothioate linkage; each $N_a$ and $N_a'$ independently represents an oligonucleotide sequence comprising 0-25 nucleotides which are either modified or unmodified or combinations thereof, each sequence comprising at least two differently modified nucleotides; each $N_b$ and $N_b'$ independently represents an oligonucleotide sequence comprising 0-10 nucleotides which are either modified or unmodified or combinations thereof; XXX, YYY, ZZZ, X'X'X', Y'Y'Y', and Z'Z'Z' each independently represent one motif of three identical modifications on three consecutive nucleotides, and wherein the modifications are 2'-O-methyl or 2'-fluoro modifications; modifications on $N_b$ differ from the modification on Y and modifications on $N_b'$ differ from the modification on Y'; and wherein the sense strand is conjugated to at least one ligand, wherein the ligand is one or more GalNAc derivatives attached through a bivalent or trivalent branched linker.

In another aspect, the invention provides a double stranded ribonucleic acid (RNAi) agent for inhibiting the expression of PNPLA3 in a cell, wherein the double stranded RNAi agent comprises a sense strand complementary to an antisense strand, wherein the antisense strand comprises a region complementary to part of an mRNA encoding PNPLA3, wherein each strand is about 14 to about 30 nucleotides in length, wherein the double stranded RNAi agent is represented by formula (III):

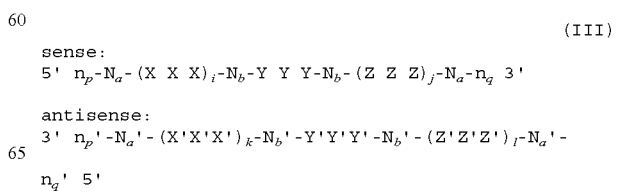

wherein i, j, k, and l are each independently 0 or 1; each $n_p$, $n_q$, and $n_q'$, each of which may or may not be present, independently represents an overhang nucleotide; p, q, and q' are each independently 0-6; $n_p'>0$ and at least one $n_p'$ is linked to a neighboring nucleotide via a phosphorothioate linkage; each $N_a$ and $N_a'$ independently represents an oligonucleotide sequence comprising 0-25 nucleotides which are either modified or unmodified or combinations thereof, each sequence comprising at least two differently modified nucleotides; each $N_b$ and $N_b'$ independently represents an oligonucleotide sequence comprising 0-10 nucleotides which are either modified or unmodified or combinations thereof; XXX, YYY, ZZZ, X'X'X', Y'Y'Y', and Z'Z'Z' each independently represent one motif of three identical modifications on three consecutive nucleotides, and wherein the modifications are 2'-O-methyl or 2'-fluoro modifications; modifications on $N_b$ differ from the modification on Y and modifications on $N_b'$ differ from the modification on Y'; wherein the sense strand comprises at least one phosphorothioate linkage; and wherein the sense strand is conjugated to at least one ligand, wherein the ligand is one or more GalNAc derivatives attached through a bivalent or trivalent branched linker.

In another aspect, the invention provides a double stranded ribonucleic acid (RNAi) agent for inhibiting the expression of PNPLA3 in a cell, wherein the double stranded RNAi agent comprises a sense strand complementary to an antisense strand, wherein the antisense strand comprises a region complementary to part of an mRNA encoding PNPLA3, wherein each strand is about 14 to about 30 nucleotides in length, wherein the double stranded RNAi agent is represented by formula (III):

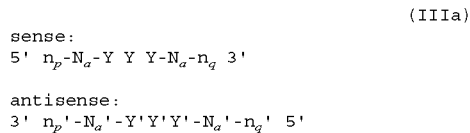

(IIIa)

wherein each $n_p$, $n_q$, and $n_q'$, each of which may or may not be present, independently represents an overhang nucleotide; p, q, and q' are each independently 0-6; $n_p'>0$ and at least one $n_p'$ is linked to a neighboring nucleotide via a phosphorothioate linkage; each $N_a$ and $N_a'$ independently represents an oligonucleotide sequence comprising 0-25 nucleotides which are either modified or unmodified or combinations thereof, each sequence comprising at least two differently modified nucleotides; YYY and Y'Y'Y' each independently represent one motif of three identical modifications on three consecutive nucleotides, and wherein the modifications are 2'-O-methyl or 2'-fluoro modifications; wherein the sense strand comprises at least one phosphorothioate linkage; and wherein the sense strand is conjugated to at least one ligand, wherein the ligand is one or more GalNAc derivatives attached through a bivalent or trivalent branched linker.

In another aspect, the invention provides a double stranded-ribonucleic acid (RNAi) agent for inhibiting expression of PNPLA3, wherein the double stranded RNAi agent comprises a sense strand and an antisense strand forming a double stranded region, wherein the sense strand comprises at least 15 contiguous nucleotides differing by no more than 3 nucleotides from the nucleotide sequence of SEQ ID NO:1 and the antisense strand comprises at least 15 contiguous nucleotides differing by no more than 3 nucleotides from the nucleotide sequence of SEQ ID NO:2, wherein substantially all of the nucleotides of the sense strand comprise a modification selected from the group consisting of a 2'-O-methyl modification and a 2'-fluoro modification, wherein the sense strand comprises two phosphorothioate internucleotide linkages at the 5'-terminus, wherein substantially all of the nucleotides of the antisense strand comprise a modification selected from the group consisting of a 2'-O-methyl modification and a 2'-fluoro modification, wherein the antisense strand comprises two phosphorothioate internucleotide linkages at the 5'-terminus and two phosphorothioate internucleotide linkages at the 3'-terminus, and wherein the sense strand is conjugated to one or more GalNAc derivatives attached through a branched bivalent or trivalent linker at the 3'-terminus.

In one embodiment, all of the nucleotides of the sense strand and all of the nucleotides of the antisense strand are modified nucleotides. In another embodiment, each strand has 19-30 nucleotides.

In another aspect, the invention provides a cell containing the double stranded RNAi agent as described herein.

In another aspect, the invention provides a vector encoding at least one strand of a double stranded RNAi agent, wherein the double stranded RNAi agent comprises a region of complementarity to at least a part of an mRNA encoding PNPLA3, wherein the double stranded RNAi agent is 30 base pairs or less in length, and wherein the double stranded RNAi agent targets the mRNA for cleavage. In one embodiment, the region of complementarity is at least 15 nucleotides in length. In another embodiment, the region of complementarity is 19 to 21 nucleotides in length.

In another aspect, the invention provides a cell comprising a vector as described herein.

In another aspect, the invention provides a pharmaceutical composition for inhibiting expression of a PNPLA3 gene comprising the double stranded RNAi agent of the invention. In one embodiment, the double stranded RNAi agent is administered in an unbuffered solution. In another embodiment, the unbuffered solution is saline or water. In another embodiment, the double stranded RNAi agent is administered with a buffer solution. In another embodiment, the buffer solution comprises acetate, citrate, prolamine, carbonate, or phosphate or any combination thereof. In another embodiment, the buffer solution is phosphate buffered saline (PBS).

In another aspect, the invention provides a pharmaceutical composition comprising the double stranded RNAi agent of the invention and a lipid formulation. In one embodiment, the lipid formulation comprises a LNP. In another embodiment, the lipid formulation comprises a MC3.

In another aspect, the invention provides a method of inhibiting PNPLA3 expression in a cell, the method comprising (a) contacting the cell with the double stranded RNAi agent of the invention or a pharmaceutical composition of the invention; and (b) maintaining the cell produced in step (a) for a time sufficient to obtain degradation of the mRNA transcript of a PNPLA3 gene, thereby inhibiting expression of the PNPLA3 gene in the cell. In one embodiment, the cell is within a subject. In another embodiment, the subject is a human. In one embodiment, the subject is a female human. In another embodiment, the subject is a male human. In one embodiment, the PNPLA3 expression is inhibited by at least about 30%, about 40%, about 50%, about 60%, about 70%, about 80%, about 90%, about 95%, about 98% or about 100%.

In another aspect, the invention provides a method of treating a subject having a disease or disorder that would benefit from reduction in PNPLA3 expression, the method comprising administering to the subject a therapeutically effective amount of the double stranded RNAi agent of the invention or a pharmaceutical composition of the invention, thereby treating the subject.

In another aspect, the invention provides a method of preventing at least one symptom in a subject having a disease or disorder that would benefit from reduction in PNPLA3 expression, the method comprising administering to the subject a prophylactically effective amount of the double stranded RNAi agent of the invention or a pharmaceutical composition of the invention, thereby preventing at least one symptom in the subject having a disorder that would benefit from reduction in PNPLA3 expression.

In one embodiment, the administration of the double stranded RNAi to the subject causes a decrease in the hedgehog signaling pathway.

In one embodiment, the PNPLA3-associated disease is a PNPLA3-associated disease. In another embodiment, the PNPLA3-associated disease is nonalcoholic fatty liver disease (NAFLD). In another embodiment, the PNPLA3-associated disease is fatty liver (steatosis). In another embodiment, the PNPLA3-associated disease is nonalcoholic steatohepatitis (NASH). In another embodiment, the PNPLA3-associated disease is obesity. In one embodiment, the subject is human. In another embodiment, the subject is a female human. In another embodiment, the subject is a male human. In one embodiment, the subject has a PNPLA3 I148M mutation. In one embodiment, the mutation is heterozygous. In another embodiment, the mutation is homozygous.

In another embodiment, the invention further comprises administering an anti-PNPLA3 antibody, or antigen-binding fragment thereof, to the subject.

In one embodiment, the double stranded RNAi agent is administered at a dose of about 0.01 mg/kg to about 10 mg/kg or about 0.5 mg/kg to about 50 mg/kg. In one embodiment, the dsRNA agent is administered at a dose of about 10 mg/kg to about 30 mg/kg. In another embodiment, the dsRNA agent is administered at a dose selected from the group consisting of 0.5 mg/kg 1 mg/kg, 1.5 mg/kg, 3 mg/kg, 5 mg/kg, 10 mg/kg, and 30 mg/kg.

In one embodiment, the double stranded RNAi agent is administered to the subject once a week. In another embodiment, the double stranded RNAi agent is administered to the subject once a month.

In one embodiment, the double stranded RNAi agent is administered to the subject subcutaneously.

In another embodiment, the methods of the invention further comprise measuring hedgehog signaling pathway levels in the subject. In one embodiment, a decrease in the levels of expression or activity of the hedgehog (Hh) signaling pathway indicate that the PNPLA3-associated disease is being treated or prevented.

The present invention is further illustrated by the following detailed description and drawings.

BRIEF DESCRIPTION OF THE DRAWINGS

FIG. 1 is a graph showing the percentage of PNPLA3 mRNA remaining in the liver of ob/ob mice following administration of a single dose of 0.3 mg/kg, 1.5 mg/kg, or 3.0 mg/kg of the indicated iRNA agents.

DETAILED DESCRIPTION OF THE INVENTION

The present invention provides iRNA compositions which effect the RNA-induced silencing complex (RISC)-mediated cleavage of RNA transcripts of a Patatin-Like Phospholipase Domain Containing 3 (PNPLA3) gene. The gene may be within a cell, e.g., a cell within a subject, such as a human. The use of these iRNAs enables the targeted degradation of mRNAs of the corresponding gene (PNPLA3 gene) in mammals.

The RNAi agents of the invention have been designed to target the human PNPLA3 gene, including portions of the gene that are conserved in the PNPLA3 orthologs of other mammalian species. Without intending to be limited by theory, it is believed that a combination or sub-combination of the foregoing properties and the specific target sites and/or the specific modifications in these RNAi agents confer to the RNAi agents of the invention improved efficacy, stability, potency, durability, and safety.

Accordingly, the present invention also provides methods for treating a subject having a disorder that would benefit from inhibiting or reducing the expression of a PNPLA3 gene, e.g., an PNPLA3-associated disease, such as Nonalcoholic Fatty Liver Disease (NAFLD), using iRNA compositions which effect the RNA-induced silencing complex (RISC)-mediated cleavage of RNA transcripts of a PNPLA3 gene.

Very low dosages of the iRNAs of the invention, in particular, can specifically and efficiently mediate RNA interference (RNAi), resulting in significant inhibition of expression of the corresponding gene (PNPLA3 gene).

The iRNAs of the invention include an RNA strand (the antisense strand) having a region which is about 30 nucleotides or less in length, e.g., 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length, which region is substantially complementary to at least part of an mRNA transcript of a PNPLA3 gene.

The following detailed description discloses how to make and use compositions containing iRNAs to inhibit the expression of an angiotensinogen gene as well as compositions, uses, and methods for treating subjects having diseases and disorders that would benefit from inhibition and/or reduction of the expression of a PNPLA3 gene.

I. Definitions

In order that the present invention may be more readily understood, certain terms are first defined. In addition, it should be noted that whenever a value or range of values of a parameter are recited, it is intended that values and ranges intermediate to the recited values are also intended to be part of this invention.

The articles "a" and "an" are used herein to refer to one or to more than one (i.e., to at least one) of the grammatical object of the article. By way of example, "an element" means one element or more than one element, e.g., a plurality of elements.

The term "including" is used herein to mean, and is used interchangeably with, the phrase "including but not limited to".

The term "about" is used herein to mean within the typical ranges of tolerances in the art. For example, "about" can be understood as about 2 standard deviations from the mean. In certain embodiments, about means ±10%. In certain embodiments, about means ±5%. When about is present before a series of numbers or a range, it is understood that "about" can modify each of the numbers in the series or range.

The term "at least" prior to a number or series of numbers is understood to include the number adjacent to the term "at least", and all subsequent numbers or integers that could logically be included, as clear from context. For example, the number of nucleotides in a nucleic acid molecule must be an integer. For example, "at least 18 nucleotides of a 21 nucleotide nucleic acid molecule" means that 18, 19, 20, or 21 nucleotides have the indicated property. When at least is present before a series of numbers or a range, it is understood that "at least" can modify each of the numbers in the series or range.

As used herein, "no more than" or "less than" is understood as the value adjacent to the phrase and logical lower values or integers, as logical from context, to zero. For example, a duplex with an overhang of "no more than 2 nucleotides" has a 2, 1, or 0 nucleotide overhang. When "no more than" is present before a series of numbers or a range, it is understood that "no more than" can modify each of the numbers in the series or range.

As used herein, "Patatin-Like Phospholipase Domain Containing 3," used interchangeably with the term "PNPLA3," refers to the naturally occurring gene that encodes a triacylglycerol lipase that mediates triacyl glycerol hydrolysis in adipocytes. The amino acid and complete coding sequences of the reference sequence of the human PNPLA3 gene may be found in, for example, GenBank Accession No. GI:17196625 (RefSeq Accession No. NM_025225.2; SEQ ID NO:1; SEQ ID NO:2). Mammalian orthologs of the human PNPLA3 gene may be found in, for example, GenBank Accession Nos. GI: 544461323 (RefSeq Accession No. XM_005567051.1, cynomolgus monkey; SEQ ID NO:7 and SEQ ID NO:8); GI: 544461325 (RefSeq Accession No. XM_005567052.1, cynomolgus monkey; SEQ ID NO:11 and SEQ ID NO:12); GI:297261270 (RefSeq Accession No. XM_001109144.2, rhesus monkey, SEQ ID NO:9 and SEQ ID NO:10); GI:144226244 (RefSeq Accession No. NM_054088.3, mouse; SEQ ID NO:3 and SEQ ID NO:4); GI:537361027 (RefSeq Accession No. NM_001282324.1, rat; SEQ ID NO:5 and SEQ ID NO:6).

Additional examples of PNPLA3 mRNA sequences are readily available using publicly available databases, e.g., GenBank, UniProt, and OMIM.

As used herein, "target sequence" refers to a contiguous portion of the nucleotide sequence of an mRNA molecule formed during the transcription of an PNPLA3 gene, including mRNA that is a product of RNA processing of a primary transcription product. In one embodiment, the target portion of the sequence will be at least long enough to serve as a substrate for iRNA-directed cleavage at or near that portion of the nucleotide sequence of an mRNA molecule formed during the transcription of an PNPLA3 gene. In one embodiment, the target sequence is within the protein coding region of PNPLA3.

The target sequence may be from about 9-36 nucleotides in length, e.g., about 15-30 nucleotides in length. For example, the target sequence can be from about 15-30 nucleotides, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. Ranges and lengths intermediate to the above recited ranges and lengths are also contemplated to be part of the invention.

As used herein, the term "strand comprising a sequence" refers to an oligonucleotide comprising a chain of nucleotides that is described by the sequence referred to using the standard nucleotide nomenclature.

"G," "C," "A," "T" and "U" each generally stand for a nucleotide that contains guanine, cytosine, adenine, thymidine and uracil as a base, respectively. However, it will be understood that the term "ribonucleotide" or "nucleotide" can also refer to a modified nucleotide, as further detailed below, or a surrogate replacement moiety (see, e.g., Table 2). The skilled person is well aware that guanine, cytosine, adenine, and uracil can be replaced by other moieties without substantially altering the base pairing properties of an oligonucleotide comprising a nucleotide bearing such replacement moiety. For example, without limitation, a nucleotide comprising inosine as its base can base pair with nucleotides containing adenine, cytosine, or uracil. Hence, nucleotides containing uracil, guanine, or adenine can be replaced in the nucleotide sequences of dsRNA featured in the invention by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods featured in the invention.

The terms "iRNA", "RNAi agent," "iRNA agent,", "RNA interference agent" as used interchangeably herein, refer to an agent that contains RNA as that term is defined herein, and which mediates the targeted cleavage of an RNA transcript via an RNA-induced silencing complex (RISC) pathway. iRNA directs the sequence-specific degradation of mRNA through a process known as RNA interference (RNAi). The iRNA modulates, e.g., inhibits, the expression of a PNPLA3 gene in a cell, e.g., a cell within a subject, such as a mammalian subject.

In one embodiment, an RNAi agent of the invention includes a single stranded RNAi that interacts with a target RNA sequence, e.g., a PNPLA3 target mRNA sequence, to direct the cleavage of the target RNA. Without wishing to be bound by theory it is believed that long double stranded RNA introduced into cells is broken down into double stranded short interfering RNAs (siRNAs) comprising a sense strand and an antisense strand by a Type III endonuclease known as Dicer (Sharp et al. (2001) *Genes Dev.* 15:485). Dicer, a ribonuclease-III-like enzyme, processes these dsRNA into 19-23 base pair short interfering RNAs with characteristic two base 3' overhangs (Bernstein, et al., (2001) *Nature* 409:363). These siRNAs are then incorporated into an RNA-induced silencing complex (RISC) where one or more helicases unwind the siRNA duplex, enabling the complementary antisense strand to guide target recognition (Nykanen, et al., (2001) *Cell* 107:309). Upon binding to the appropriate target mRNA, one or more endonucleases within the RISC cleave the target to induce silencing (Elbashir, et al., (2001) *Genes Dev.* 15:188). Thus, in one aspect the invention relates to a single stranded RNA (ssRNA) (the antisense strand of an siRNA duplex) generated within a cell and which promotes the formation of a RISC complex to effect silencing of the target gene, i.e., a PNPLA3 gene. Accordingly, the term "siRNA" is also used herein to refer to an RNAi as described above.

In another embodiment, the RNAi agent may be a single-stranded RNA that is introduced into a cell or organism to inhibit a target mRNA. Single-stranded RNAi agents bind to the RISC endonuclease, Argonaute 2, which then cleaves the target mRNA. The single-stranded siRNAs are generally 15-30 nucleotides and are chemically modified. The design and testing of single-stranded RNAs are described in U.S. Pat. No. 8,101,348 and in Lima et al., (2012) Cell 150:883-894, the entire contents of each of which are hereby incorporated herein by reference. Any of the antisense nucleotide sequences described herein may be used as a single-stranded siRNA as described herein or as chemically modified by the methods described in Lima et al., (2012) Cell 150:883-894.

In another embodiment, an "iRNA" for use in the compositions, uses, and methods of the invention is a double stranded RNA and is referred to herein as a "double stranded RNAi agent," "double stranded RNA (dsRNA) molecule," "dsRNA agent" or "dsRNA". The term "dsRNA", refers to a complex of ribonucleic acid molecules, having a duplex structure comprising two anti-parallel and substantially complementary nucleic acid strands, referred to as having "sense" and "antisense" orientations with respect to a target RNA, i.e., an PNPLA3 gene. In some embodiments of the invention, a double stranded RNA (dsRNA) triggers the degradation of a target RNA, e.g., an mRNA, through a post-transcriptional gene-silencing mechanism referred to herein as RNA interference or RNAi.

In general, the majority of nucleotides of each strand of a dsRNA molecule are ribonucleotides, but as described in detail herein, each or both strands can also include one or more non-ribonucleotides, e.g., a deoxyribonucleotide and/or a modified nucleotide. In addition, as used in this specification, an "RNAi agent" may include ribonucleotides with chemical modifications; an RNAi agent may include substantial modifications at multiple nucleotides. As used herein, the term "modified nucleotide" refers to a nucleotide having, independently, a modified sugar moiety, a modified internucleotide linkage, and/or modified nucleobase. Thus, the term modified nucleotide encompasses substitutions, additions or removal of, e.g., a functional group or atom, to internucleoside linkages, sugar moieties, or nucleobases. The modifications suitable for use in the agents of the invention include all types of modifications disclosed herein or known in the art. Any such modifications, as used in a siRNA type molecule, are encompassed by "RNAi agent" for the purposes of this specification and claims.

The duplex region may be of any length that permits specific degradation of a desired target RNA through a RISC pathway, and may range from about 9 to 36 base pairs in length, e.g., about 15-30 base pairs in length, for example, about 9, 10, 11, 12, 13, 14, 15, 16, 17, 18, 19, 20, 21, 22, 23, 24, 25, 26, 27, 28, 29, 30, 31, 32, 33, 34, 35, or 36 base pairs in length, such as about 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. Ranges and lengths intermediate to the above recited ranges and lengths are also contemplated to be part of the invention.

The two strands forming the duplex structure may be different portions of one larger RNA molecule, or they may be separate RNA molecules. Where the two strands are part of one larger molecule, and therefore are connected by an uninterrupted chain of nucleotides between the 3'-end of one strand and the 5'-end of the respective other strand forming the duplex structure, the connecting RNA chain is referred to as a "hairpin loop." A hairpin loop can comprise at least one unpaired nucleotide. In some embodiments, the hairpin loop can comprise at least 2, at least 3, at least 4, at least 5, at least 6, at least 7, at least 8, at least 9, at least 10, at least 20, at least 23 or more unpaired nucleotides. In some embodiments, the hairpin loop can be 8 or fewer unpaired nucleotides. In some embodiments, the hairpin loop can be 4-10 unpaired nucleotides. In some embodiments, the hairpin loop can be 4-8 nucleotides.

Where the two substantially complementary strands of a dsRNA are comprised by separate RNA molecules, those molecules need not, but can be covalently connected. Where the two strands are connected covalently by means other than an uninterrupted chain of nucleotides between the 3'-end of one strand and the 5'-end of the respective other strand forming the duplex structure, the connecting structure is referred to as a "linker." The RNA strands may have the same or a different number of nucleotides. The maximum number of base pairs is the number of nucleotides in the shortest strand of the dsRNA minus any overhangs that are present in the duplex. In addition to the duplex structure, an RNAi may comprise one or more nucleotide overhangs.

In one embodiment, an RNAi agent of the invention is a dsRNA of 24-30 nucleotides that interacts with a target RNA sequence, e.g., an PNPLA3 target mRNA sequence, to direct the cleavage of the target RNA. Without wishing to be bound by theory, long double stranded RNA introduced into cells is broken down into siRNA by a Type III endonuclease known as Dicer (Sharp et al. (2001) Genes Dev. 15:485). Dicer, a ribonuclease-III-like enzyme, processes the dsRNA into 19-23 base pair short interfering RNAs with characteristic two base 3' overhangs (Bernstein, et al., (2001) Nature 409:363). The siRNAs are then incorporated into an RNA-induced silencing complex (RISC) where one or more helicases unwind the siRNA duplex, enabling the complementary antisense strand to guide target recognition (Nykanen, et al., (2001) Cell 107:309). Upon binding to the appropriate target mRNA, one or more endonucleases within the RISC cleave the target to induce silencing (Elbashir, et al., (2001) Genes Dev. 15:188).

As used herein, the term "nucleotide overhang" refers to at least one unpaired nucleotide that protrudes from the duplex structure of an iRNA, e.g., a dsRNA. For example, when a 3'-end of one strand of a dsRNA extends beyond the 5'-end of the other strand, or vice versa, there is a nucleotide overhang. A dsRNA can comprise an overhang of at least one nucleotide; alternatively the overhang can comprise at least two nucleotides, at least three nucleotides, at least four nucleotides, at least five nucleotides or more. A nucleotide overhang can comprise or consist of a nucleotide/nucleoside analog, including a deoxynucleotide/nucleoside. The overhang(s) can be on the sense strand, the antisense strand or any combination thereof. Furthermore, the nucleotide(s) of an overhang can be present on the 5'-end, 3'-end or both ends of either an antisense or sense strand of a dsRNA.

In one embodiment, the antisense strand of a dsRNA has a 1-10 nucleotide, e.g., a 1, 2, 3, 4, 5, 6, 7, 8, 9, or 10 nucleotide, overhang at the 3'-end and/or the 5'-end. In one embodiment, the sense strand of a dsRNA has a 1-10 nucleotide, e.g., a 1, 2, 3, 4, 5, 6, 7, 8, 9, or 10 nucleotide, overhang at the 3'-end and/or the 5'-end. In another embodiment, one or more of the nucleotides in the overhang is replaced with a nucleoside thiophosphate. In certain embodiments, the overhang on the sense strand or the antisense strand, or both, can include extended lengths longer than 10 nucleotides, e.g., 1-30 nucleotides, 2-30 nucleotides, 10-30 nucleotides, or 10-15 nucleotides in length. In certain embodiments, an extended overhang is on the sense strand of the duplex. In certain embodiments, an extended overhang is present on the 3'end of the sense strand of the duplex. In certain embodiments, an extended overhang is present on the 5'end of the sense strand of the duplex. In certain embodiments, an extended overhang is on the antisense strand of the duplex. In certain embodiments, an extended overhang is present on the 3'end of the antisense strand of the duplex. In certain embodiments, an extended overhang is present on the 5'end of the antisense strand of the duplex. In certain embodiments, one or more of the nucleotides in the overhang is replaced with a nucleoside thiophosphate.

"Blunt" or "blunt end" means that there are no unpaired nucleotides at that end of the double stranded RNAi agent, i.e., no nucleotide overhang. A "blunt ended" RNAi agent is a dsRNA that is double stranded over its entire length, i.e., no nucleotide overhang at either end of the molecule. The RNAi agents of the invention include RNAi agents with nucleotide overhangs at one end (i.e., agents with one overhang and one blunt end) or with nucleotide overhangs at both ends. To be clear, a "blunt ended" dsRNA is a dsRNA that is blunt at both ends, i.e., no nucleotide overhang at either end of the molecule. Most often such a molecule will be double stranded over its entire length.

The term "antisense strand" or "guide strand" refers to the strand of an iRNA, e.g., a dsRNA, which includes a region that is substantially complementary to a target sequence, e.g., a PNPLA3 mRNA. As used herein, the term "region of complementarity" refers to the region on the antisense strand that is substantially complementary to a sequence, for example a target sequence, e.g., an PNPLA3 nucleotide sequence, as defined herein. Where the region of complementarity is not fully complementary to the target sequence, the mismatches can be in the internal or terminal regions of the molecule. Generally, the most tolerated mismatches are in the terminal regions, e.g., within 5, 4, 3, 2, or 1 nucleotides of the 5'- and/or 3'-terminus of the iRNA. In one embodiment, a double stranded RNAi agent of the invention includes a nucleotide mismatch in the antisense strand. In another embodiment, a double stranded RNAi agent of the invention includea a nucleotide mismatch in the sense strand. In one embodiment, the nucleotide mismatch is, for example, within 5, 4, 3, 2, or 1 nucleotides from the 3'-terminus of the iRNA. In another embodiment, the nucleotide mismatch is, for example, in the 3'-terminal nucleotide of the iRNA.

The term "sense strand," or "passenger strand" as used herein, refers to the strand of an iRNA that includes a region that is substantially complementary to a region of the antisense strand as that term is defined herein.

As used herein, the term "cleavage region" refers to a region that is located immediately adjacent to the cleavage site. The cleavage site is the site on the target at which cleavage occurs. In some embodiments, the cleavage region comprises three bases on either end of, and immediately adjacent to, the cleavage site. In some embodiments, the cleavage region comprises two bases on either end of, and immediately adjacent to, the cleavage site. In some embodiments, the cleavage site specifically occurs at the site bound by nucleotides 10 and 11 of the antisense strand, and the cleavage region comprises nucleotides 11, 12 and 13.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can, for example, be stringent conditions, where stringent conditions can include: 400 mM NaCl, 40 mM PIPES pH 6.4, 1 mM EDTA, 50° C. or 70° C. for 12-16 hours followed by washing (see, e.g., "Molecular Cloning: A Laboratory Manual, Sambrook, et al. (1989) Cold Spring Harbor Laboratory Press). Other conditions, such as physiologically relevant conditions as can be encountered inside an organism, can apply. The skilled person will be able to determine the set of conditions most appropriate for a test of complementarity of two sequences in accordance with the ultimate application of the hybridized nucleotides.

Complementary sequences within an iRNA, e.g., within a dsRNA as described herein, include base-pairing of the oligonucleotide or polynucleotide comprising a first nucleotide sequence to an oligonucleotide or polynucleotide comprising a second nucleotide sequence over the entire length of one or both nucleotide sequences. Such sequences can be referred to as "fully complementary" with respect to each other herein. However, where a first sequence is referred to as "substantially complementary" with respect to a second sequence herein, the two sequences can be fully complementary, or they can form one or more, but generally not more than 5, 4, 3 or 2 mismatched base pairs upon hybridization for a duplex up to 30 base pairs, while retaining the ability to hybridize under the conditions most relevant to their ultimate application, e.g., inhibition of gene expression via a RISC pathway. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, can yet be referred to as "fully complementary" for the purposes described herein.

"Complementary" sequences, as used herein, can also include, or be formed entirely from, non-Watson-Crick base pairs and/or base pairs formed from non-natural and modified nucleotides, in so far as the above requirements with respect to their ability to hybridize are fulfilled. Such non-Watson-Crick base pairs include, but are not limited to, G:U Wobble or Hoogstein base pairing.

The terms "complementary," "fully complementary" and "substantially complementary" herein can be used with respect to the base matching between the sense strand and the antisense strand of a dsRNA, or between the antisense strand of an iRNA agent and a target sequence, as will be understood from the context of their use.

As used herein, a polynucleotide that is "substantially complementary to at least part of" a messenger RNA (mRNA) refers to a polynucleotide that is substantially complementary to a contiguous portion of the mRNA of interest (e.g., an mRNA encoding a PNPLA3 gene). For example, a polynucleotide is complementary to at least a part of an PNPLA3 mRNA if the sequence is substantially complementary to a non-interrupted portion of an mRNA encoding a PNPLA3 gene.

Accordingly, in some embodiments, the antisense polynucleotides disclosed herein are fully complementary to the target PNPLA3 sequence. In other embodiments, the antisense polynucleotides disclosed herein are substantially complementary to the target PNPLA3 sequence and comprise a contiguous nucleotide sequence which is at least about 80% complementary over its entire length to the equivalent region of the nucleotide sequence of SEQ ID NO:1, or a fragment of SEQ ID NO:1, such as about 85%, about 86%, about 87%, about 88%, about 89%, about 90%, about % 91%, about 92%, about 93%, about 94%, about 95%, about 96%, about 97%, about 98%, or about 99% complementary.

In one embodiment, an RNAi agent of the invention includes a sense strand that is substantially complementary to an antisense polynucleotide which, in turn, is complementary to a target PNPLA3 sequence, and wherein the sense strand polynucleotide comprises a contiguous nucleotide sequence which is at least about 80% complementary over its entire length to the equivalent region of the nucleotide sequence of SEQ ID NO:2, or, or a fragment of SEQ ID NO:2, such as about 85%, about 86%, about 87%, about 88%, about 89%, about 90%, about % 91%, about 92%, about 93%, about 94%, about 95%, about 96%, about 97%, about 98%, or about 99% complementary.

In another embodiment, an RNAi agent of the invention includes a sense strand that is substantially complementary to an antisense polynucleotide which, in turn, is complementary to a target PNPLA3 sequence, and wherein the sense strand polynucleotide comprises a contiguous nucleotide sequence which is at least about 80% complementary over its entire length to the equivalent region of the nucleotide sequence of any one of the sense strands in any one of Tables 3-5, 7, and 8, or a fragment of any one of the sense strands in any one of Tables 3-5, 7, and 8, such as about 85%, about 86%, about 87%, about 88%, about 89%, about 90%, about % 91%, about 92%, about 93%, about 94%, about 95%, about 96%, about 97%, about 98%, or about 99% complementary.

In one aspect of the invention, an agent for use in the methods and compositions of the invention is a single-stranded antisense oligonucleotide molecule that inhibits a target mRNA via an antisense inhibition mechanism. The single-stranded antisense oligonucleotide molecule is complementary to a sequence within the target mRNA. The single-stranded antisense oligonucleotides can inhibit translation in a stoichiometric manner by base pairing to the mRNA and physically obstructing the translation machinery, see Dias, N. et al., (2002) *Mol Cancer Ther* 1:347-355. The single-stranded antisense oligonucleotide molecule may be about 15 to about 30 nucleotides in length and have a sequence that is complementary to a target sequence. For example, the single-stranded antisense oligonucleotide molecule may comprise a sequence that is at least about 15, 16, 17, 18, 19, 20, or more contiguous nucleotides from any one of the antisense sequences described herein.

As used herein, a "subject" is an animal, such as a mammal, including a primate (such as a human, a non-human primate, e.g., a monkey, and a chimpanzee), a non-primate (such as a cow, a pig, a camel, a llama, a horse, a goat, a rabbit, a sheep, a hamster, a guinea pig, a cat, a dog, a rat, a mouse, a horse, and a whale), or a bird (e.g., a duck or a goose). In an embodiment, the subject is a human, such as a human being treated or assessed for a disease, disorder or condition that would benefit from reduction in PNPLA3 gene expression and/or replication; a human at risk for a disease, disorder or condition that would benefit from reduction in PNPLA3 gene expression; a human having a disease, disorder or condition that would benefit from reduction in PNPLA3 gene expression; and/or human being treated for a disease, disorder or condition that would benefit from reduction in PNPLA3 gene expression, as described herein. In one embodiment, the subject is a female human. In another embodiment, the subject is a male human.

As used herein, the terms "treating" or "treatment" refer to a beneficial or desired result including, but not limited to, alleviation or amelioration of one or more symptoms associated with PNPLA3 gene expression and/or PNPLA3 protein production, e.g., the presence of increased protein activity in the hedgehog (Hh) signaling pathway, fatty liver (steatosis), nonalcoholic steatohepatitis (NASH), cirrhosis of the liver, accumulation of fat in the liver, inflammation of the liver, hepatocellular necrosis, liver fibrosis, obesity, or nonalcoholic fatty liver disease (NAFLD). "Treatment" can also mean prolonging survival as compared to expected survival in the absence of treatment.

The term "lower" in the context of the level of PNPLA3 gene expression and/or PNPLA3 protein production in a subject or a disease marker or symptom refers to a statistically significant decrease in such level. The decrease can be, for example, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or more and is preferably down to a level accepted as within the range of normal for an individual without such disorder.

As used herein, "prevention" or "preventing," when used in reference to a disease, disorder or condition thereof, that would benefit from a reduction in expression of an PNPLA3 gene and/or production of PNPLA3 protein, refers to a reduction in the likelihood that a subject will develop a symptom associated with such a disease, disorder, or condition, e.g., a symptom of PNPLA3 gene expression, such as the presence of elevated levels of proteins in the hedgehog signaling pathway, fatty liver (steatosis), nonalcoholic steatohepatitis (NASH), cirrhosis of the liver, accumulation of fat in the liver, inflammation of the liver, hepatocellular necrosis, liver fibrosis, obesity, or nonalcoholic fatty liver disease (NAFLD). The failure to develop a disease, disorder or condition, or the reduction in the development of a symptom associated with such a disease, disorder or condition (e.g., by at least about 10% on a clinically accepted scale for that disease or disorder), or the exhibition of delayed symptoms delayed (e.g., by days, weeks, months or years) is considered effective prevention.

As used herein, the term "Patatin-Like Phospholipase Domain Containing 3-associated disease" or "PNPLA3-associated disease," is a disease or disorder that is caused by, or associated with PNPLA3 gene expression or PNPLA3 protein production. The term "PNPLA3-associated disease" includes a disease, disorder or condition that would benefit from a decrease in PNPLA3 gene expression, replication, or protein activity. Non-limiting examples of PNPLA3-associated diseases include, for example, fatty liver (steatosis), nonalcoholic steatohepatitis (NASH), cirrhosis of the liver, accumulation of fat in the liver, inflammation of the liver, hepatocellular necrosis, liver fibrosis, obesity, or nonalcoholic fatty liver disease (NAFLD). In another embodiment, the PNPLA3-associated disease is nonalcoholic fatty liver disease (NAFLD). In another embodiment, the PNPLA3-associated disease is nonalcoholic steatohepatitis (NASH). In another embodiment, the PNPLA3-associated disease is liver cirrhosis. In another embodiment, the PNPLA3-associated disease is insulin resistance. In another embodiment, the PNPLA3-associated disease is not insulin resistance. In one embodiment, the PNPLA3-associated disease is obesity.

In one embodiment, an PNPLA3-associated disease is nonalcoholic fatty liver disease (NAFLD). As used herein, "nonalcoholic fatty liver disease," used interchangeably with the term "NAFLD," refers to a disease defined by the presence of macrovascular steatosis in the presence of less than 20 gm of alcohol ingestion per day. NAFLD is the most common liver disease in the United States, and is commonly associated with insulin resistance/type 2 diabetes mellitus and obesity. NAFLD is manifested by steatosis, steatohepatitis, cirrhosis, and sometimes hepatocellaular carcinoma. For a review of NAFLD, see Tolman and Dalpiaz (2007) *Ther. Clin. Risk. Manag.*, 3(6):1153-1163 the entire contents of which are incorporated herein by reference.

"Therapeutically effective amount," as used herein, is intended to include the amount of an RNAi agent that, when administered to a patient for treating a subject having PNPLA3-associated disease, is sufficient to effect treatment of the disease (e.g., by diminishing, ameliorating or maintaining the existing disease or one or more symptoms of disease). The "therapeutically effective amount" may vary depending on the RNAi agent, how the agent is administered, the disease and its severity and the history, age, weight, family history, genetic makeup, stage of pathological processes mediated by PNPLA3 gene expression, the types of preceding or concomitant treatments, if any, and other individual characteristics of the patient to be treated.

"Prophylactically effective amount," as used herein, is intended to include the amount of an RNAi agent that, when administered to a subject who does not yet experience or display symptoms of a PNPLA3-associated disease, but who may be predisposed, is sufficient to prevent or ameliorate the disease or one or more symptoms of the disease. Ameliorating the disease includes slowing the course of the disease or reducing the severity of later-developing disease. The "prophylactically effective amount" may vary depending on the RNAi agent, how the agent is administered, the degree of risk of disease, and the history, age, weight, family history, genetic makeup, the types of preceding or concomitant treatments, if any, and other individual characteristics of the patient to be treated.

A "therapeutically-effective amount" or "prophylacticaly effective amount" also includes an amount of an RNAi agent that produces some desired local or systemic effect at a reasonable benefit/risk ratio applicable to any treatment. RNAi agents employed in the methods of the present invention may be administered in a sufficient amount to produce a reasonable benefit/risk ratio applicable to such treatment.

The phrase "pharmaceutically acceptable" is employed herein to refer to those compounds, materials, compositions, and/or dosage forms which are, within the scope of sound medical judgment, suitable for use in contact with the tissues of human subjects and animal subjects without excessive toxicity, irritation, allergic response, or other problem or complication, commensurate with a reasonable benefit/risk ratio.

The phrase "pharmaceutically-acceptable carrier" as used herein means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the subject compound from one organ, or portion of the body, to another organ, or portion of the body. Each carrier must be "acceptable" in the sense of being compatible with the other ingredients of the formulation and not injurious to the subject being treated. Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, ethyl cellulose and cellulose acetate; (4) powdered tragacanth; (5) malt; (6) gelatin; (7) lubricating agents, such as magnesium state, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol; (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum component, such as serum albumin, HDL and LDL; and (22) other non-toxic compatible substances employed in pharmaceutical formulations.

The term "sample," as used herein, includes a collection of similar fluids, cells, or tissues isolated from a subject, as well as fluids, cells, or tissues present within a subject. Examples of biological fluids include blood, serum and serosal fluids, plasma, cerebrospinal fluid, ocular fluids, lymph, urine, saliva, and the like. Tissue samples may include samples from tissues, organs or localized regions. For example, samples may be derived from particular organs, parts of organs, or fluids or cells within those organs. In certain embodiments, samples may be derived from the liver (e.g., whole liver or certain segments of liver or certain types of cells in the liver, such as, e.g., hepatocytes), the retina or parts of the retina (e.g., retinal pigment epithelium), the central nervous system or parts of the central nervous system (e.g., ventricles or choroid plexus), or the pancreas or certain cells or parts of the pancreas. In some embodiments, a "sample derived from a subject" refers tocerebrospinal fluid obtained from the subject. In preferred embodiments, a "sample derived from a subject" refers to blood or plasma drawn from the subject. In further embodiments, a "sample derived from a subject" refers to liver tissue (or subcomponents thereof) or retinal tissue (or subcomponents thereof) derived from the subject.

II. iRNAs of the Invention

The present invention provides iRNAs which inhibit the expression of a PNPLA3 gene. In one embodiment, the iRNA agent includes double stranded ribonucleic acid (dsRNA) molecules for inhibiting the expression of a PNPLA3 gene in a cell, such as a cell within a subject, e.g., a mammal, such as a human having an PNPLA3-associated disease, e.g., nonalcoholic fatty liver disease (NAFLD). The dsRNA includes an antisense strand having a region of complementarity which is complementary to at least a part of an mRNA formed in the expression of an PNPLA3 gene. The region of complementarity is about 30 nucleotides or less in length (e.g., about 30, 29, 28, 27, 26, 25, 24, 23, 22, 21, 20, 19, or 18 nucleotides or less in length). Upon contact with a cell expressing the PNPLA3 gene, the iRNA inhibits the expression of the PNPLA3 gene (e.g., a human, a primate, a non-primate, or a bird PNPLA3 gene) by at least about 10% as assayed by, for example, a PCR or branched DNA (bDNA)-based method, or by a protein-based method, such as by immunofluorescence analysis, using, for example, Western Blotting or flowcytometric techniques.

A dsRNA includes two RNA strands that are complementary and hybridize to form a duplex structure under conditions in which the dsRNA will be used. One strand of a dsRNA (the antisense strand) includes a region of complementarity that is substantially complementary, and generally fully complementary, to a target sequence. The target sequence can be derived from the sequence of an mRNA formed during the expression of an PNPLA3 gene. The other strand (the sense strand) includes a region that is complementary to the antisense strand, such that the two strands hybridize and form a duplex structure when combined under suitable conditions. As described elsewhere herein and as known in the art, the complementary sequences of a dsRNA can also be contained as self-complementary regions of a single nucleic acid molecule, as opposed to being on separate oligonucleotides.

Generally, the duplex structure is between 15 and 30 base pairs in length, e.g., between, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. Ranges and lengths intermediate to the above recited ranges and lengths are also contemplated to be part of the invention.

Similarly, the region of complementarity to the target sequence is between 15 and 30 nucleotides in length, e.g., between 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. Ranges and lengths intermediate to the above recited ranges and lengths are also contemplated to be part of the invention.

In some embodiments, the dsRNA is between about 15 and about 23 nucleotides in length, or between about 25 and about 30 nucleotides in length. In general, the dsRNA is long enough to serve as a substrate for the Dicer enzyme. For example, it is well-known in the art that dsRNAs longer than about 21-23 nucleotides in length may serve as substrates for Dicer. As the ordinarily skilled person will also recognize, the region of an RNA targeted for cleavage will most often be part of a larger RNA molecule, often an mRNA molecule. Where relevant, a "part" of an mRNA target is a contiguous sequence of an mRNA target of sufficient length to allow it to be a substrate for RNAi-directed cleavage (i.e., cleavage through a RISC pathway).

One of skill in the art will also recognize that the duplex region is a primary functional portion of a dsRNA, e.g., a duplex region of about 9 to 36 base pairs, e.g., about 10-36, 11-36, 12-36, 13-36, 14-36, 15-36, 9-35, 10-35, 11-35, 12-35, 13-35, 14-35, 15-35, 9-34, 10-34, 11-34, 12-34, 13-34, 14-34, 15-34, 9-33, 10-33, 11-33, 12-33, 13-33, 14-33, 15-33, 9-32, 10-32, 11-32, 12-32, 13-32, 14-32, 15-32, 9-31, 10-31, 11-31, 12-31, 13-32, 14-31, 15-31, 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs. Thus, in one embodiment, to the extent that it becomes processed to a functional duplex, of e.g., 15-30 base pairs, that targets a desired RNA for cleavage, an RNA molecule or complex of RNA molecules having a duplex region greater than 30 base pairs is a dsRNA. Thus, an ordinarily skilled artisan will recognize that in one embodiment, a miRNA is a dsRNA. In another embodiment, a dsRNA is not a naturally occurring miRNA. In another embodiment, an iRNA agent useful to target PNPLA3 gene expression is not generated in the target cell by cleavage of a larger dsRNA.

A dsRNA as described herein can further include one or more single-stranded nucleotide overhangs e.g., 1, 2, 3, or 4 nucleotides. dsRNAs having at least one nucleotide overhang can have unexpectedly superior inhibitory properties relative to their blunt-ended counterparts. A nucleotide overhang can comprise or consist of a nucleotide/nucleoside analog, including a deoxynucleotide/nucleoside. The overhang(s) can be on the sense strand, the antisense strand or any combination thereof. Furthermore, the nucleotide(s) of an overhang can be present on the 5'-end, 3'-end or both ends of either an antisense or sense strand of a dsRNA.

A dsRNA can be synthesized by standard methods known in the art as further discussed below, e.g., by use of an automated DNA synthesizer, such as are commercially available from, for example, Biosearch, Applied Biosystems, Inc.

iRNA compounds of the invention may be prepared using a two-step procedure. First, the individual strands of the double stranded RNA molecule are prepared separately. Then, the component strands are annealed. The individual strands of the siRNA compound can be prepared using solution-phase or solid-phase organic synthesis or both. Organic synthesis offers the advantage that the oligonucleotide strands comprising unnatural or modified nucleotides can be easily prepared. Single-stranded oligonucleotides of the invention can be prepared using solution-phase or solid-phase organic synthesis or both.

In one aspect, a dsRNA of the invention includes at least two nucleotide sequences, a sense sequence and an antisense sequence. The sense strand is selected from the group of sequences provided in any one of Tables 3-5, 7, and 8, and the corresponding antisense strand of the sense strand is selected from the group of sequences of any one of Tables 3-5, 7, and 8. In this aspect, one of the two sequences is complementary to the other of the two sequences, with one of the sequences being substantially complementary to a sequence of an mRNA generated in the expression of an PNPLA3 gene. As such, in this aspect, a dsRNA will include two oligonucleotides, where one oligonucleotide is described as the sense strand in any one of Tables 3-5, 7, and 8, and the second oligonucleotide is described as the corresponding antisense strand of the sense strand in any one of Tables 3-5, 7, and 8. In one embodiment, the substantially complementary sequences of the dsRNA are contained on separate oligonucleotides. In another embodiment, the substantially complementary sequences of the dsRNA are contained on a single oligonucleotide.

It will be understood that, although the sequences in any one of Tables 3, 4, and 7 are not described as modified and/or conjugated sequences, the RNA of the iRNA of the invention e.g., a dsRNA of the invention, may comprise any one of the sequences set forth in any one of Tables 3-5, 7, and 8, or the sequences of any one of Tables 3-5, 7, and 8 that are modified, or the sequences of any one of Tables 3-5, 7, and 8 that are conjugated. In other words, the invention encompasses dsRNA of any one of Tables 3-5, 7, and 8 which are unmodified, un-conjugated, modified, and/or conjugated, as described herein.

In another aspect, a double stranded ribonucleic acid (dsRNA) of the invention for inhibiting expression of PNPLA3 comprises, consists essentially of, or consists of a sense strand and an antisense strand, wherein the sense strand comprises the nucleotide sequence of a sense strand in any one of Tables 3-5, 7, and 8 and the antisense strand comprises the nucleotide sequence of the corresponding antisense strand in any one of Tables 3-5, 7, and 8.

The skilled person is well aware that dsRNAs having a duplex structure of between about 20 and 23 base pairs, e.g., 21, base pairs have been hailed as particularly effective in inducing RNA interference (Elbashir et al., *EMBO* 2001, 20:6877-6888). However, others have found that shorter or longer RNA duplex structures can also be effective (Chu and Rana (2007) *RNA* 14:1714-1719; Kim et al. (2005) *Nat Biotech* 23:222-226). In the embodiments described above, by virtue of the nature of the oligonucleotide sequences provided in any one of Table 3-5, 7, and 8, dsRNAs described herein can include at least one strand of a length of minimally 21 nucleotides. It can be reasonably expected that shorter duplexes having one of the sequences of any one of Tables 3-5, 7, and 8 minus only a few nucleotides on one or both ends can be similarly effective as compared to the dsRNAs described above. Hence, dsRNAs having a sequence of at least 15, 16, 17, 18, 19, 20, or more contiguous nucleotides derived from one of the sequences of Tany one of Tables 3-5, 7, and 8, and differing in their ability to inhibit the expression of a PNPLA3 gene by not more than about 5, 10, 15, 20, 25, or 30% inhibition from a dsRNA comprising the full sequence, are contemplated to be within the scope of the present invention.

In addition, the RNAs provided in any one of Tables 3-5, 7, and 8 identify a site(s) in a PNPLA3 transcript that is susceptible to RISC-mediated cleavage (see, e.g., Table 9). As such, the present invention further features iRNAs that target within one of these sites. As used herein, an iRNA is said to target within a particular site of an RNA transcript if the iRNA promotes cleavage of the transcript anywhere within that particular site. Such an iRNA will generally include at least about 15 contiguous nucleotides from one of the sequences provided in any one of Tables 3-5, 7, and 8 coupled to additional nucleotide sequences taken from the region contiguous to the selected sequence in a PNPLA3 gene.

While a target sequence is generally about 15-30 nucleotides in length, there is wide variation in the suitability of particular sequences in this range for directing cleavage of any given target RNA. Various software packages and the guidelines set out herein provide guidance for the identification of optimal target sequences for any given gene target, but an empirical approach can also be taken in which a "window" or "mask" of a given size (as a non-limiting example, 21 nucleotides) is literally or figuratively (including, e.g., in silico) placed on the target RNA sequence to identify sequences in the size range that can serve as target sequences. By moving the sequence "window" progressively one nucleotide upstream or downstream of an initial target sequence location, the next potential target sequence can be identified, until the complete set of possible sequences is identified for any given target size selected. Thus, while the sequences identified, for example, in any one of Tables 3-5, 7, and 8 represent effective target sequences, it is contemplated that further optimization of inhibition efficiency can be achieved by progressively "walking the window" one nucleotide upstream or downstream of the given sequences to identify sequences with equal or better inhibition characteristics.

Further, it is contemplated that for any sequence identified, e.g., in any one of Tables 3-5, 7, and 8, further optimization could be achieved by systematically either adding or removing nucleotides to generate longer or shorter sequences and testing those sequences generated by walking a window of the longer or shorter size up or down the target RNA from that point. Again, coupling this approach to generating new candidate targets with testing for effectiveness of iRNAs based on those target sequences in an inhibition assay as known in the art and/or as described herein can lead to further improvements in the efficiency of inhibition. Further still, such optimized sequences can be adjusted by, e.g., the introduction of modified nucleotides as described herein or as known in the art, addition or changes in overhang, or other modifications as known in the art and/or discussed herein to further optimize the molecule (e.g., increasing serum stability or circulating half-life, increasing thermal stability, enhancing transmembrane delivery, targeting to a particular location or cell type, increasing interaction with silencing pathway enzymes, increasing release from endosomes) as an expression inhibitor.

An iRNA as described herein can contain one or more mismatches to the target sequence. In one embodiment, an iRNA as described herein contains no more than 3 mismatches. If the antisense strand of the iRNA contains mismatches to a target sequence, it is preferable that the area of mismatch is not located in the center of the region of complementarity. If the antisense strand of the iRNA contains mismatches to the target sequence, it is preferable that the mismatch be restricted to be within the last 5 nucleotides from either the 5'- or 3'-end of the region of complementarity. For example, for a 23 nucleotide iRNA agent the strand which is complementary to a region of an PNPLA3 gene, generally does not contain any mismatch within the central 13 nucleotides. The methods described herein or methods known in the art can be used to determine whether an iRNA containing a mismatch to a target sequence is effective in inhibiting the expression of an PNPLA3 gene. Consideration of the efficacy of iRNAs with mismatches in inhibiting expression of an PNPLA3 gene is important, especially if the particular region of complementarity in an PNPLA3 gene is known to have polymorphic sequence variation within the population.

III. Modified iRNAs of the Invention

In one embodiment, the RNA of the iRNA of the invention e.g., a dsRNA, is unmodified, and does not comprise, e.g., chemical modifications and/or conjugations known in the art and described herein. In another embodiment, the RNA of an iRNA of the invention, e.g., a dsRNA, is chemically modified to enhance stability or other beneficial characteristics. In certain embodiments of the invention, substantially all of the nucleotides of an iRNA of the invention are modified. In other embodiments of the invention, all of the nucleotides of an iRNA of the invention are modified iRNAs of the invention in which "substantially all of the nucleotides are modified" are largely but not wholly modified and can include not more than 5, 4, 3, 2, or 1 unmodified nucleotides.

The nucleic acids featured in the invention can be synthesized and/or modified by methods well established in the art, such as those described in "Current protocols in nucleic acid chemistry," Beaucage, S. L. et al. (Edrs.), John Wiley & Sons, Inc., New York, N.Y., USA, which is hereby incorporated herein by reference. Modifications include, for example, end modifications, e.g., 5'-end modifications (phosphorylation, conjugation, inverted linkages) or 3'-end modifications (conjugation, DNA nucleotides, inverted linkages, etc.); base modifications, e.g., replacement with stabilizing bases, destabilizing bases, or bases that base pair with an expanded repertoire of partners, removal of bases (abasic nucleotides), or conjugated bases; sugar modifications (e.g., at the 2'-position or 4'-position) or replacement of the sugar; and/or backbone modifications, including modification or replacement of the phosphodiester linkages. Specific examples of iRNA compounds useful in the embodiments described herein include, but are not limited to RNAs containing modified backbones or no natural internucleoside linkages. RNAs having modified backbones include, among others, those that do not have a phosphorus atom in the backbone. For the purposes of this specification, and as sometimes referenced in the art, modified RNAs that do not have a phosphorus atom in their internucleoside backbone can also be considered to be oligonucleosides. In some embodiments, a modified iRNA will have a phosphorus atom in its internucleoside backbone.

Modified RNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5'-linked analogs of these, and those having inverted polarity wherein the adjacent pairs of nucleoside units are linked 3'-5' to 5'-3' or 2'-5' to 5'-2'. Various salts, mixed salts and free acid forms are also included.

Representative U.S. patents that teach the preparation of the above phosphorus-containing linkages include, but are not limited to, U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; 5,625,050; 6,028,188; 6,124,445; 6,160,109; 6,169,170; 6,172,209; 6,239,265; 6,277,603; 6,326,199; 6,346,614; 6,444,423; 6,531,590; 6,534,639; 6,608,035; 6,683,167; 6,858,715; 6,867,294; 6,878,805; 7,015,315; 7,041,816; 7,273,933; 7,321,029; and U.S. Pat. RE39464, the entire contents of each of which are hereby incorporated herein by reference.

Modified RNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

Representative U.S. patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and, 5,677,439, the entire contents of each of which are hereby incorporated herein by reference.

In other embodiments, suitable RNA mimetics are contemplated for use in iRNAs, in which both the sugar and the internucleoside linkage, i.e., the backbone, of the nucleotide units are replaced with novel groups. The base units are maintained for hybridization with an appropriate nucleic acid target compound. One such oligomeric compound, an RNA mimetic that has been shown to have excellent hybridization properties, is referred to as a peptide nucleic acid (PNA). In PNA compounds, the sugar backbone of an RNA is replaced with an amide containing backbone, in particular an aminoethylglycine backbone. The nucleobases are retained and are bound directly or indirectly to aza nitrogen atoms of the amide portion of the backbone. Representative U.S. patents that teach the preparation of PNA compounds include, but are not limited to, U.S. Pat. Nos. 5,539,082; 5,714,331; and 5,719,262, the entire contents of each of which are hereby incorporated herein by reference. Additional PNA compounds suitable for use in the iRNAs of the invention are described in, for example, in Nielsen et al., *Science*, 1991, 254, 1497-1500.

Some embodiments featured in the invention include RNAs with phosphorothioate backbones and oligonucleosides with heteroatom backbones, and in particular —$CH_2$—NH—$CH_2$—, —$CH_2$—N($CH_3$)—O—$CH_2$— [known as a methylene (methylimino) or MMI backbone], —$CH_2$—O—N($CH_3$)—$CH_2$—, —$CH_2$—N($CH_3$)—N($CH_3$)—$CH_2$— and —N($CH_3$)—$CH_2$—$CH_2$— [wherein the native phosphodiester backbone is represented as —O—P—O—$CH_2$—] of the above-referenced U.S. Pat. No. 5,489,677, and the amide backbones of the above-referenced U.S. Pat. No. 5,602,240. In some embodiments, the RNAs featured herein have morpholino backbone structures of the above-referenced U.S. Pat. No. 5,034,506.

Modified RNAs can also contain one or more substituted sugar moieties. The iRNAs, e.g., dsRNAs, featured herein can include one of the following at the 2'-position: OH; F; O-, S-, or N-alkyl; O-, S-, or N-alkenyl; O-, S- or N-alkynyl; or O-alkyl-O-alkyl, wherein the alkyl, alkenyl and alkynyl can be substituted or unsubstituted $C_1$ to $C_{10}$ alkyl or $C_2$ to $C_{10}$ alkenyl and alkynyl. Exemplary suitable modifications include O[($CH_2$)$_n$O]$_m$$CH_3$, O($CH_2$)$_{·n}$O$CH_3$, O($CH_2$)$_n$$NH_2$, O($CH_2$)$_n$$CH_3$, O($CH_2$)$_n$O$NH_2$, and O($CH_2$)$_n$ON[($CH_2$)$_n$$CH_3$)]$_2$, where n and m are from 1 to about 10. In other embodiments, dsRNAs include one of the following at the 2' position: $C_1$ to $C_{10}$ lower alkyl, substituted lower alkyl, alkaryl, aralkyl, O-alkaryl or O-aralkyl, SH, S$CH_3$, OCN, Cl, Br, CN, $CF_3$, O$CF_3$, SO$CH_3$, $SO_2$$CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an iRNA, or a group for improving the pharmacodynamic properties of an iRNA, and other substituents having similar properties. In some embodiments, the modification includes a 2'-methoxyethoxy (2'-O—$CH_2$$CH_2$O$CH_3$, also known as 2'-O-(2-methoxyethyl) or 2'-MOE) (Martin et al., *Helv. Chim. Acta*, 1995, 78:486-504) i.e., an alkoxy-alkoxy group. Another exemplary modification is 2'-dimethylaminooxyethoxy, i.e., a O($CH_2$)$_2$ON($CH_3$)$_2$ group, also known as 2'-DMAOE, and 2'-dimethylaminoethoxyethoxy (also known in the art as 2'-O-dimethylaminoethoxyethyl or 2'-DMAEOE), i.e., 2'-O—$CH_2$—O—$CH_2$—N($CH_2$)$_2$.

Other modifications include 2'-methoxy (2'-OCH$_3$), 2'-aminopropoxy (2'-OCH$_2$CH$_2$CH$_2$NH$_2$) and 2'-fluoro (2'-F) Similar modifications can also be made at other positions on the RNA of an iRNA, particularly the 3' position of the sugar on the 3' terminal nucleotide or in 2'-5' linked dsRNAs and the 5' position of 5' terminal nucleotide. iRNAs can also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application. The entire contents of each of the foregoing are hereby incorporated herein by reference.

An iRNA can also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as deoxy-thymine (dT), 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia Of Polymer Science And Engineering, pages 858-859, Kroschwitz, J. L, ed. John Wiley & Sons, 1990, these disclosed by Englisch et al., Angewandte Chemie, International Edition, 1991, 30, 613, and those disclosed by Sanghvi, Y S., Chapter 15, dsRNA Research and Applications, pages 289-302, Crooke, S. T. and Lebleu, B., Ed., CRC Press, 1993. Certain of these nucleobases are particularly useful for increasing the binding affinity of the oligomeric compounds featured in the invention. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

Representative U.S. patents that teach the preparation of certain of the above noted modified nucleobases as well as other modified nucleobases include, but are not limited to, the above noted U.S. Pat. Nos. 3,687,808, 4,845,205; 5,130, 30; 5,134,066; 5,175,273; 5,367,066; 5,432,272; 5,457,187; 5,459,255; 5,484,908; 5,502,177; 5,525,711; 5,552,540; 5,587,469; 5,594,121, 5,596,091; 5,614,617; 5,681,941; 5,750,692; 6,015,886; 6,147,200; 6,166,197; 6,222,025; 6,235,887; 6,380,368; 6,528,640; 6,639,062; 6,617,438; 7,045,610; 7,427,672; and 7,495,088, the entire contents of each of which are hereby incorporated herein by reference.

The RNA of an iRNA can also be modified to include one or more bicyclic sugar moities. A "bicyclic sugar" is a furanosyl ring modified by the bridging of two atoms. A "bicyclic nucleoside" ("BNA") is a nucleoside having a sugar moiety comprising a bridge connecting two carbon atoms of the sugar ring, thereby forming a bicyclic ring system. In certain embodiments, the bridge connects the 4'-carbon and the 2'-carbon of the sugar ring. Thus, in some embodiments an agent of the invention may include one or more locked nucleic acids (LNA). A locked nucleic acid is a nucleotide having a modified ribose moiety in which the ribose moiety comprises an extra bridge connecting the 2' and 4' carbons. In other words, an LNA is a nucleotide comprising a bicyclic sugar moiety comprising a 4'-CH2-O-2' bridge. This structure effectively "locks" the ribose in the 3'-endo structural conformation. The addition of locked nucleic acids to siRNAs has been shown to increase siRNA stability in serum, and to reduce off-target effects (Elmen, J. et al., (2005) Nucleic Acids Research 33(1):439-447; Mook, O R. et al., (2007) Mol Canc Ther 6(3):833-843; Grunweller, A. et al., (2003) Nucleic Acids Research 31(12):3185-3193). Examples of bicyclic nucleosides for use in the polynucleotides of the invention include without limitation nucleosides comprising a bridge between the 4' and the 2' ribosyl ring atoms. In certain embodiments, the antisense polynucleotide agents of the invention include one or more bicyclic nucleosides comprising a 4' to 2' bridge. Examples of such 4' to 2' bridged bicyclic nucleosides, include but are not limited to 4'-(CH2)-O-2' (LNA); 4'-(CH2)-S-2'; 4'-(CH2)2-O-2' (ENA); 4'-CH(CH3)-O-2' (also referred to as "constrained ethyl" or "cEt") and 4'-CH(CH2OCH3)-O-2' (and analogs thereof; see, e.g., U.S. Pat. No. 7,399,845); 4'-C (CH3)(CH3)-O-2' (and analogs thereof; see e.g., U.S. Pat. No. 8,278,283); 4'-CH2-N(OCH3)-2' (and analogs thereof; see e.g., U.S. Pat. No. 8,278,425); 4'-CH2-O—N(CH3)-2' (see, e.g., U.S. Patent Publication No. 2004/0171570); 4'-CH2-N(R)—O-2', wherein R is H, C1-C12 alkyl, or a protecting group (see, e.g., U.S. Pat. No. 7,427,672); 4'-CH2-C(H)(CH3)-2' (see, e.g., Chattopadhyaya et al., J. Org. Chem., 2009, 74, 118-134); and 4'-CH2-C(=CH2)-2' (and analogs thereof; see, e.g., U.S. Pat. No. 8,278,426). The entire contents of each of the foregoing are hereby incorporated herein by reference.

Additional representative U.S. Patents and US Patent Publications that teach the preparation of locked nucleic acid nucleotides include, but are not limited to, the following: U.S. Pat. Nos. 6,268,490; 6,525,191; 6,670,461; 6,770,748; 6,794,499; 6,998,484; 7,053,207; 7,034,133; 7,084,125; 7,399,845; 7,427,672; 7,569,686; 7,741,457; 8,022,193; 8,030,467; 8,278,425; 8,278,426; 8,278,283; US 2008/ 0039618; and US 2009/0012281, the entire contents of each of which are hereby incorporated herein by reference.

In some embodiments, the iRNA of the invention comprises one or more monomers that are UNA (unlocked nucleic acid) nucleotides. UNA is unlocked acyclic nucleic acid, wherein any of the bonds of the sugar has been removed, forming an unlocked "sugar" residue. In one example, UNA also encompasses monomer with bonds between C1'-C4' have been removed (i.e. the covalent carbon-oxygen-carbon bond between the C1' and C4' carbons). In another example, the C2'-C3' bond (i.e. the covalent carbon-carbon bond between the C2' and C3' carbons) of the sugar has been removed (see Nuc. Acids Symp. Series, 52, 133-134 (2008) and Fluiter et al., *Mol. Biosyst.*, 2009, 10, 1039 hereby incorporated by reference).

Any of the foregoing bicyclic nucleosides can be prepared having one or more stereochemical sugar configurations including for example α-L-ribofuranose and β-D-ribofuranose (see WO 99/14226).

The RNA of an iRNA can also be modified to include one or more constrained ethyl nucleotides. As used herein, a "constrained ethyl nucleotide" or "cEt" is a locked nucleic acid comprising a bicyclic sugar moiety comprising a 4'-CH (CH3)-0-2' bridge. In one embodiment, a constrained ethyl nucleotide is in the S conformation referred to herein as "S-cEt."

An iRNA of the invention may also include one or more "conformationally restricted nucleotides" ("CRN"). CRN are nucleotide analogs with a linker connecting the C2' and C4' carbons of ribose or the C3 and -C5' carbons of ribose. CRN lock the ribose ring into a stable conformation and increase the hybridization affinity to mRNA. The linker is of sufficient length to place the oxygen in an optimal position for stability and affinity resulting in less ribose ring puckering.

Representative publications that teach the preparation of certain of the above noted CRN include, but are not limited to, US Patent Publication No. 2013/0190383; and PCT publication WO 2013/036868, the entire contents of each of which are hereby incorporated herein by reference.

One or more of the nucleotides of an iRNA of the invention may also include a hydroxymethyl substituted nucleotide. A "hydroxymethyl substituted nucleotide" is an acyclic 2'-3'-seco-nucleotide, also referred to as an "unlocked nucleic acid" ("UNA") modification Representative U.S. publications that teach the preparation of UNA include, but are not limited to, U.S. Pat. No. 8,314,227; and US Patent Publication Nos. 2013/0096289; 2013/0011922; and 2011/0313020, the entire contents of each of which are hereby incorporated herein by reference.

Potentially stabilizing modifications to the ends of RNA molecules can include N-(acetylaminocaproyl)-4-hydroxyprolinol (Hyp-C6-NHAc), N-(caproyl-4-hydroxyprolinol (Hyp-C6), N-(acetyl-4-hydroxyprolinol (Hyp-NHAc), thymidine-2'-0-deoxythymidine (ether), N-(aminocaproyl)-4-hydroxyprolinol (Hyp-C6-amino), 2-docosanoyl-uridine-3"-phosphate, inverted base dT(idT) and others. Disclosure of this modification can be found in PCT Publication No. WO 2011/005861.

Other modifications of the nucleotides of an iRNA of the invention include a 5' phosphate or 5' phosphate mimic, e.g., a 5'-terminal phosphate or phosphate mimic on the antisense strand of an RNAi agent. Suitable phosphate mimics are disclosed in, for example US Patent Publication No. 2012/0157511, the entire contents of which are incorporated herein by reference.

A. Modified iRNAs Comprising Motifs of the Invention

In certain aspects of the invention, the double stranded RNAi agents of the invention include agents with chemical modifications as disclosed, for example, in U.S. Provisional Application No. 61/561,710, filed on Nov. 18, 2011, or in PCT/US2012/065691, filed on Nov. 16, 2012, the entire contents of each of which are incorporated herein by reference.

As shown herein and in Provisional Application No. 61/561,710 or PCT Application No. PCT/US2012/065691, a superior result may be obtained by introducing one or more motifs of three identical modifications on three consecutive nucleotides into a sense strand and/or antisense strand of an RNAi agent, particularly at or near the cleavage site. In some embodiments, the sense strand and antisense strand of the RNAi agent may otherwise be completely modified. The introduction of these motifs interrupts the modification pattern, if present, of the sense and/or antisense strand. The RNAi agent may be optionally conjugated with a GalNAc derivative ligand, for instance on the sense strand. The resulting RNAi agents present superior gene silencing activity.

More specifically, it has been surprisingly discovered that when the sense strand and antisense strand of the double stranded RNAi agent are completely modified to have one or more motifs of three identical modifications on three consecutive nucleotides at or near the cleavage site of at least one strand of an RNAi agent, the gene silencing activity of the RNAi agent was superiorly enhanced.

Accordingly, the invention provides double stranded RNAi agents capable of inhibiting the expression of a target gene (i.e., PNPLA3 gene) in vivo. The RNAi agent comprises a sense strand and an antisense strand. Each strand of the RNAi agent may range from 12-30 nucleotides in length. For example, each strand may be between 14-30 nucleotides in length, 17-30 nucleotides in length, 25-30 nucleotides in length, 27-30 nucleotides in length, 17-23 nucleotides in length, 17-21 nucleotides in length, 17-19 nucleotides in length, 19-25 nucleotides in length, 19-23 nucleotides in length, 19-21 nucleotides in length, 21-25 nucleotides in length, or 21-23 nucleotides in length.

The sense strand and antisense strand typically form a duplex double stranded RNA ("dsRNA"), also referred to herein as an "RNAi agent." The duplex region of an RNAi agent may be 12-30 nucleotide pairs in length. For example, the duplex region can be between 14-30 nucleotide pairs in length, 17-30 nucleotide pairs in length, 27-30 nucleotide pairs in length, 17-23 nucleotide pairs in length, 17-21 nucleotide pairs in length, 17-19 nucleotide pairs in length, 19-25 nucleotide pairs in length, 19-23 nucleotide pairs in length, 19-21 nucleotide pairs in length, 21-25 nucleotide pairs in length, or 21-23 nucleotide pairs in length. In another example, the duplex region is selected from 15, 16, 17, 18, 19, 20, 21, 22, 23, 24, 25, 26, and 27 nucleotides in length.

In one embodiment, the RNAi agent may contain one or more overhang regions and/or capping groups at the 3'-end, 5'-end, or both ends of one or both strands. The overhang can be 1-6 nucleotides in length, for instance 2-6 nucleotides in length, 1-5 nucleotides in length, 2-5 nucleotides in length, 1-4 nucleotides in length, 2-4 nucleotides in length, 1-3 nucleotides in length, 2-3 nucleotides in length, or 1-2 nucleotides in length. The overhangs can be the result of one strand being longer than the other, or the result of two strands of the same length being staggered. The overhang can form a mismatch with the target mRNA or it can be complementary to the gene sequences being targeted or can be another sequence. The first and second strands can also be joined, e.g., by additional bases to form a hairpin, or by other non-base linkers.

In one embodiment, the nucleotides in the overhang region of the RNAi agent can each independently be a modified or unmodified nucleotide including, but no limited to 2'-sugar modified, such as, 2-F, 2'-Omethyl, thymidine (T), 2'-O-methoxyethyl-5-methyluridine (Teo), 2'-O-methoxyethyladenosine (Aeo), 2'-O-methoxyethyl-5-methylcytidine (m5Ceo), and any combinations thereof. For example, TT can be an overhang sequence for either end on either strand. The overhang can form a mismatch with the target mRNA or it can be complementary to the gene sequences being targeted or can be another sequence.

The 5'- or 3'-overhangs at the sense strand, antisense strand or both strands of the RNAi agent may be phosphorylated. In some embodiments, the overhang region(s) contains two nucleotides having a phosphorothioate between the two nucleotides, where the two nucleotides can be the same or different. In one embodiment, the overhang is present at the 3'-end of the sense strand, antisense strand, or both strands. In one embodiment, this 3'-overhang is present in the antisense strand. In one embodiment, this 3'-overhang is present in the sense strand.

The RNAi agent may contain only a single overhang, which can strengthen the interference activity of the RNAi, without affecting its overall stability. For example, the single-stranded overhang may be located at the 3'-terminal end of the sense strand or, alternatively, at the 3'-terminal end of the antisense strand. The RNAi may also have a blunt end, located at the 5'-end of the antisense strand (or the 3'-end of the sense strand) or vice versa. Generally, the antisense strand of the RNAi has a nucleotide overhang at the 3'-end, and the 5'-end is blunt. While not wishing to be bound by theory, the asymmetric blunt end at the 5'-end of the antisense strand and 3'-end overhang of the antisense strand favor the guide strand loading into RISC process.

In one embodiment, the RNAi agent is a double ended bluntmer of 19 nucleotides in length, wherein the sense strand contains at least one motif of three 2'-F modifications on three consecutive nucleotides at positions 7, 8, 9 from the 5'end. The antisense strand contains at least one motif of three 2'-O-methyl modifications on three consecutive nucleotides at positions 11, 12, 13 from the 5'end.

In another embodiment, the RNAi agent is a double ended bluntmer of 20 nucleotides in length, wherein the sense strand contains at least one motif of three 2'-F modifications on three consecutive nucleotides at positions 8, 9, 10 from the 5'end. The antisense strand contains at least one motif of three 2'-O-methyl modifications on three consecutive nucleotides at positions 11, 12, 13 from the 5'end.

In yet another embodiment, the RNAi agent is a double ended bluntmer of 21 nucleotides in length, wherein the sense strand contains at least one motif of three 2'-F modifications on three consecutive nucleotides at positions 9, 10, 11 from the 5'end. The antisense strand contains at least one motif of three 2'-O-methyl modifications on three consecutive nucleotides at positions 11, 12, 13 from the 5'end.

In one embodiment, the RNAi agent comprises a 21 nucleotide sense strand and a 23 nucleotide antisense strand, wherein the sense strand contains at least one motif of three 2'-F modifications on three consecutive nucleotides at positions 9, 10, 11 from the 5'end; the antisense strand contains at least one motif of three 2'-O-methyl modifications on three consecutive nucleotides at positions 11, 12, 13 from the 5'end, wherein one end of the RNAi agent is blunt, while the other end comprises a 2 nucleotide overhang. Preferably, the 2 nucleotide overhang is at the 3'-end of the antisense strand.

When the 2 nucleotide overhang is at the 3'-end of the antisense strand, there may be two phosphorothioate internucleotide linkages between the terminal three nucleotides, wherein two of the three nucleotides are the overhang nucleotides, and the third nucleotide is a paired nucleotide next to the overhang nucleotide. In one embodiment, the RNAi agent additionally has two phosphorothioate internucleotide linkages between the terminal three nucleotides at both the 5'-end of the sense strand and at the 5'-end of the antisense strand. In one embodiment, every nucleotide in the sense strand and the antisense strand of the RNAi agent, including the nucleotides that are part of the motifs are modified nucleotides. In one embodiment each residue is independently modified with a 2'-O-methyl or 3'-fluoro, e.g., in an alternating motif. Optionally, the RNAi agent further comprises a ligand (preferably GalNAc$_3$).

In one embodiment, the RNAi agent comprises a sense and an antisense strand, wherein the sense strand is 25-30 nucleotide residues in length, wherein starting from the 5' terminal nucleotide (position 1) positions 1 to 23 of the first strand comprise at least 8 ribonucleotides; the antisense strand is 36-66 nucleotide residues in length and, starting from the 3' terminal nucleotide, comprises at least 8 ribonucleotides in the positions paired with positions 1-23 of sense strand to form a duplex; wherein at least the 3 ' terminal nucleotide of antisense strand is unpaired with sense strand, and up to 6 consecutive 3' terminal nucleotides are unpaired with sense strand, thereby forming a 3' single stranded overhang of 1-6 nucleotides; wherein the 5' terminus of antisense strand comprises from 10-30 consecutive nucleotides which are unpaired with sense strand, thereby forming a 10-30 nucleotide single stranded 5' overhang; wherein at least the sense strand 5' terminal and 3' terminal nucleotides are base paired with nucleotides of antisense strand when sense and antisense strands are aligned for maximum complementarity, thereby forming a substantially duplexed region between sense and antisense strands; and antisense strand is sufficiently complementary to a target RNA along at least 19 ribonucleotides of antisense strand length to reduce target gene expression when the double stranded nucleic acid is introduced into a mammalian cell; and wherein the sense strand contains at least one motif of three 2'-F modifications on three consecutive nucleotides, where at least one of the motifs occurs at or near the cleavage site. The antisense strand contains at least one motif of three 2'-O-methyl modifications on three consecutive nucleotides at or near the cleavage site.

In one embodiment, the RNAi agent comprises sense and antisense strands, wherein the RNAi agent comprises a first strand having a length which is at least 25 and at most 29 nucleotides and a second strand having a length which is at most 30 nucleotides with at least one motif of three 2'-O-methyl modifications on three consecutive nucleotides at position 11, 12, 13 from the 5' end; wherein the 3' end of the first strand and the 5' end of the second strand form a blunt end and the second strand is 1-4 nucleotides longer at its 3' end than the first strand, wherein the duplex region region which is at least 25 nucleotides in length, and the second strand is sufficiently complementary to a target mRNA along at least 19 nucleotide of the second strand length to reduce target gene expression when the RNAi agent is introduced into a mammalian cell, and wherein dicer cleavage of the RNAi agent preferentially results in an siRNA comprising the 3' end of the second strand, thereby reducing expression of the target gene in the mammal. Optionally, the RNAi agent further comprises a ligand.

In one embodiment, the sense strand of the RNAi agent contains at least one motif of three identical modifications on three consecutive nucleotides, where one of the motifs occurs at the cleavage site in the sense strand.

In one embodiment, the antisense strand of the RNAi agent can also contain at least one motif of three identical modifications on three consecutive nucleotides, where one of the motifs occurs at or near the cleavage site in the antisense strand.

For an RNAi agent having a duplex region of 17-23 nucleotide in length, the cleavage site of the antisense strand is typically around the 10, 11 and 12 positions from the 5'-end. Thus the motifs of three identical modifications may occur at the 9, 10, 11 positions; 10, 11, 12 positions; 11, 12, 13 positions; 12, 13, 14 positions; or 13, 14, 15 positions of the antisense strand, the count starting from the 1$^{st}$ nucleotide from the 5'-end of the antisense strand, or, the count starting from the 1$^{st}$ paired nucleotide within the duplex region from the 5'-end of the antisense strand. The cleavage site in the antisense strand may also change according to the length of the duplex region of the RNAi from the 5'-end.

The sense strand of the RNAi agent may contain at least one motif of three identical modifications on three consecutive nucleotides at the cleavage site of the strand; and the antisense strand may have at least one motif of three identical modifications on three consecutive nucleotides at or near the cleavage site of the strand. When the sense strand and the antisense strand form a dsRNA duplex, the sense strand and the antisense strand can be so aligned that one motif of the three nucleotides on the sense strand and one motif of the three nucleotides on the antisense strand have at least one nucleotide overlap, i.e., at least one of the three nucleotides of the motif in the sense strand forms a base pair with at least one of the three nucleotides of the motif in the antisense strand. Alternatively, at least two nucleotides may overlap, or all three nucleotides may overlap.

In one embodiment, the sense strand of the RNAi agent may contain more than one motif of three identical modifications on three consecutive nucleotides. The first motif may occur at or near the cleavage site of the strand and the other motifs may be a wing modification. The term "wing modification" herein refers to a motif occurring at another portion of the strand that is separated from the motif at or near the cleavage site of the same strand. The wing modification is either adjacent to the first motif or is separated by at least one or more nucleotides. When the motifs are immediately adjacent to each other then the chemistry of the motifs are distinct from each other and when the motifs are separated by one or more nucleotide than the chemistries can be the same or different. Two or more wing modifications may be present. For instance, when two wing modifications are present, each wing modification may occur at one end relative to the first motif which is at or near cleavage site or on either side of the lead motif.

Like the sense strand, the antisense strand of the RNAi agent may contain more than one motifs of three identical modifications on three consecutive nucleotides, with at least one of the motifs occurring at or near the cleavage site of the strand. This antisense strand may also contain one or more wing modifications in an alignment similar to the wing modifications that may be present on the sense strand.

In one embodiment, the wing modification on the sense strand or antisense strand of the RNAi agent typically does not include the first one or two terminal nucleotides at the 3'-end, 5'-end or both ends of the strand.

In another embodiment, the wing modification on the sense strand or antisense strand of the RNAi agent typically does not include the first one or two paired nucleotides within the duplex region at the 3'-end, 5'-end or both ends of the strand.

When the sense strand and the antisense strand of the RNAi agent each contain at least one wing modification, the wing modifications may fall on the same end of the duplex region, and have an overlap of one, two or three nucleotides.

When the sense strand and the antisense strand of the RNAi agent each contain at least two wing modifications, the sense strand and the antisense strand can be so aligned that two modifications each from one strand fall on one end of the duplex region, having an overlap of one, two or three nucleotides; two modifications each from one strand fall on the other end of the duplex region, having an overlap of one, two or three nucleotides; two modifications one strand fall on each side of the lead motif, having an overlap of one, two or three nucleotides in the duplex region.

In one embodiment, every nucleotide in the sense strand and antisense strand of the RNAi agent, including the nucleotides that are part of the motifs, may be modified. Each nucleotide may be modified with the same or different modification which can include one or more alteration of one or both of the non-linking phosphate oxygens and/or of one or more of the linking phosphate oxygens; alteration of a constituent of the ribose sugar, e.g., of the 2' hydroxyl on the ribose sugar; wholesale replacement of the phosphate moiety with "dephospho" linkers; modification or replacement of a naturally occurring base; and replacement or modification of the ribose-phosphate backbone.

As nucleic acids are polymers of subunits, many of the modifications occur at a position which is repeated within a nucleic acid, e.g., a modification of a base, or a phosphate moiety, or a non-linking O of a phosphate moiety. In some cases the modification will occur at all of the subject positions in the nucleic acid but in many cases it will not. By way of example, a modification may only occur at a 3' or 5' terminal position, may only occur in a terminal region, e.g., at a position on a terminal nucleotide or in the last 2, 3, 4, 5, or 10 nucleotides of a strand. A modification may occur in a double strand region, a single strand region, or in both. A modification may occur only in the double strand region of a RNA or may only occur in a single strand region of a RNA. For example, a phosphorothioate modification at a non-linking O position may only occur at one or both termini, may only occur in a terminal region, e.g., at a position on a terminal nucleotide or in the last 2, 3, 4, 5, or 10 nucleotides of a strand, or may occur in double strand and single strand regions, particularly at termini. The 5' end or ends can be phosphorylated.

It may be possible, e.g., to enhance stability, to include particular bases in overhangs, or to include modified nucleotides or nucleotide surrogates, in single strand overhangs, e.g., in a 5' or 3' overhang, or in both. For example, it can be desirable to include purine nucleotides in overhangs. In some embodiments all or some of the bases in a 3' or 5' overhang may be modified, e.g., with a modification described herein. Modifications can include, e.g., the use of modifications at the 2' position of the ribose sugar with modifications that are known in the art, e.g., the use of deoxyribonucleotides, 2'-deoxy-2'-fluoro (2'-F) or 2'-O-methyl modified instead of the ribosugar of the nucleobase, and modifications in the phosphate group, e.g., phosphorothioate modifications. Overhangs need not be homologous with the target sequence.

In one embodiment, each residue of the sense strand and antisense strand is independently modified with LNA, CRN, cET, UNA, HNA, CeNA, 2'-methoxyethyl, 2'-O-methyl, 2'-O-allyl, 2'-C-allyl, 2'-deoxy, 2'-hydroxyl, or 2'-fluoro. The strands can contain more than one modification. In one embodiment, each residue of the sense strand and antisense strand is independently modified with 2'-O-methyl or 2'-fluoro.

At least two different modifications are typically present on the sense strand and antisense strand. Those two modifications may be the 2'-O-methyl or 2'-fluoro modifications, or others.

In one embodiment, the $N_a$ and/or $N_b$ comprise modifications of an alternating pattern. The term "alternating motif" as used herein refers to a motif having one or more modifications, each modification occurring on alternating nucleotides of one strand. The alternating nucleotide may refer to one per every other nucleotide or one per every three nucleotides, or a similar pattern. For example, if A, B and C each represent one type of modification to the nucleotide, the alternating motif can be "ABABABABABAB . . . ," "AAB-BAABBAABB . . . ," "AABAABAABAAB . . . ," "AAABAAABAAAB . . . ," "AAABBBAAABBB . . . ," or "ABCABCABCABC . . . ," etc.

The type of modifications contained in the alternating motif may be the same or different. For example, if A, B, C, D each represent one type of modification on the nucleotide, the alternating pattern, i.e., modifications on every other nucleotide, may be the same, but each of the sense strand or antisense strand can be selected from several possibilities of modifications within the alternating motif such as "ABA-BAB . . . ", "ACACAC . . . " "BDBDBD . . . " or "CDCDCD . . . ," etc.

In one embodiment, the RNAi agent of the invention comprises the modification pattern for the alternating motif on the sense strand relative to the modification pattern for the alternating motif on the antisense strand is shifted. The shift may be such that the modified group of nucleotides of the sense strand corresponds to a differently modified group of nucleotides of the antisense strand and vice versa. For example, the sense strand when paired with the antisense strand in the dsRNA duplex, the alternating motif in the sense strand may start with "ABABAB" from 5'-3' of the strand and the alternating motif in the antisense strand may start with "BABABA" from 5'-3 'of the strand within the duplex region. As another example, the alternating motif in the sense strand may start with "AABBAABB" from 5'-3' of the strand and the alternating motif in the antisense strand may start with "BBAABBAA" from 5'-3' of the strand within the duplex region, so that there is a complete or partial shift of the modification patterns between the sense strand and the antisense strand.

In one embodiment, the RNAi agent comprises the pattern of the alternating motif of 2'-O-methyl modification and 2'-F modification on the sense strand initially has a shift relative to the pattern of the alternating motif of 2'-O-methyl modification and 2'-F modification on the antisense strand initially, i.e., the 2'-O-methyl modified nucleotide on the sense strand base pairs with a 2'-F modified nucleotide on the antisense strand and vice versa. The 1 position of the sense strand may start with the 2'-F modification, and the 1 position of the antisense strand may start with the 2'-O-methyl modification.

The introduction of one or more motifs of three identical modifications on three consecutive nucleotides to the sense strand and/or antisense strand interrupts the initial modification pattern present in the sense strand and/or antisense strand. This interruption of the modification pattern of the sense and/or antisense strand by introducing one or more motifs of three identical modifications on three consecutive nucleotides to the sense and/or antisense strand surprisingly enhances the gene silencing activity to the target gene.

In one embodiment, when the motif of three identical modifications on three consecutive nucleotides is introduced to any of the strands, the modification of the nucleotide next to the motif is a different modification than the modification of the motif. For example, the portion of the sequence containing the motif is " . . . $N_a$YYYN$_b$ . . . ," where "Y" represents the modification of the motif of three identical modifications on three consecutive nucleotide, and "$N_a$" and "$N_b$" represent a modification to the nucleotide next to the motif "YYY" that is different than the modification of Y, and where $N_a$ and $N_b$ can be the same or different modifications. Alternatively, $N_a$ and/or $N_b$ may be present or absent when there is a wing modification present.

The RNAi agent may further comprise at least one phosphorothioate or methylphosphonate internucleotide linkage. The phosphorothioate or methylphosphonate internucleotide linkage modification may occur on any nucleotide of the sense strand or antisense strand or both strands in any position of the strand. For instance, the internucleotide linkage modification may occur on every nucleotide on the sense strand and/or antisense strand; each internucleotide linkage modification may occur in an alternating pattern on the sense strand and/or antisense strand; or the sense strand or antisense strand may contain both internucleotide linkage modifications in an alternating pattern. The alternating pattern of the internucleotide linkage modification on the sense strand may be the same or different from the antisense strand, and the alternating pattern of the internucleotide linkage modification on the sense strand may have a shift relative to the alternating pattern of the internucleotide linkage modification on the antisense strand. In one embodiment, a double-stranded RNAi agent comprises 6-8phosphorothioate internucleotide linkages. In one embodiment, the antisense strand comprises two phosphorothioate internucleotide linkages at the 5'-terminus and two phosphorothioate internucleotide linkages at the 3'-terminus, and the sense strand comprises at least two phosphorothioate internucleotide linkages at either the 5'-terminus or the 3'-terminus.

In one embodiment, the RNAi comprises a phosphorothioate or methylphosphonate internucleotide linkage modification in the overhang region. For example, the overhang region may contain two nucleotides having a phosphorothioate or methylphosphonate internucleotide linkage between the two nucleotides. Internucleotide linkage modifications also may be made to link the overhang nucleotides with the terminal paired nucleotides within the duplex region. For example, at least 2, 3, 4, or all the overhang nucleotides may be linked through phosphorothioate or methylphosphonate internucleotide linkage, and optionally, there may be additional phosphorothioate or methylphosphonate internucleotide linkages linking the overhang nucleotide with a paired nucleotide that is next to the overhang nucleotide. For instance, there may be at least two phosphorothioate internucleotide linkages between the terminal three nucleotides, in which two of the three nucleotides are overhang nucleotides, and the third is a paired nucleotide next to the overhang nucleotide. These terminal three nucleotides may be at the 3'-end of the antisense strand, the 3'-end of the sense strand, the 5'-end of the antisense strand, and/or the 5'end of the antisense strand.

In one embodiment, the 2 nucleotide overhang is at the 3'-end of the antisense strand, and there are two phosphorothioate internucleotide linkages between the terminal three nucleotides, wherein two of the three nucleotides are the overhang nucleotides, and the third nucleotide is a paired nucleotide next to the overhang nucleotide. Optionally, the RNAi agent may additionally have two phosphorothioate internucleotide linkages between the terminal three nucleotides at both the 5'-end of the sense strand and at the 5'-end of the antisense strand.

In one embodiment, the RNAi agent comprises mismatch(es) with the target, within the duplex, or combinations thereof. The mismatch may occur in the overhang region or the duplex region. The base pair may be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings.

In one embodiment, the RNAi agent comprises at least one of the first 1, 2, 3, 4, or 5 base pairs within the duplex regions from the 5'-end of the antisense strand independently selected from the group of: A:U, G:U, I:C, and mismatched pairs, e.g., non-canonical or other than canonical pairings or pairings which include a universal base, to promote the dissociation of the antisense strand at the 5'-end of the duplex.

In one embodiment, the nucleotide at the 1 position within the duplex region from the 5'-end in the antisense strand is selected from the group consisting of A, dA, dU, U, and dT. Alternatively, at least one of the first 1, 2 or 3 base pair within the duplex region from the 5'-end of the antisense strand is an AU base pair. For example, the first base pair within the duplex region from the 5'-end of the antisense strand is an AU base pair.

In another embodiment, the nucleotide at the 3'-end of the sense strand is deoxy-thymine (dT). In another embodiment, the nucleotide at the 3'-end of the antisense strand is deoxy-thymine (dT). In one embodiment, there is a short sequence of deoxy-thymine nucleotides, for example, two dT nucleotides on the 3'-end of the sense and/or antisense strand.

In one embodiment, the sense strand sequence may be represented by formula (I):

(I)

wherein:
i and j are each independently 0 or 1;
p and q are each independently 0-6;
each $N_a$ independently represents an oligonucleotide sequence comprising 0-25 modified nucleotides, each sequence comprising at least two differently modified nucleotides;
each $N_b$ independently represents an oligonucleotide sequence comprising 0-10 modified nucleotides;
each $n_p$ and $n_q$ independently represent an overhang nucleotide;
wherein Nb and Y do not have the same modification; and
XXX, YYY and ZZZ each independently represent one motif of three identical modifications on three consecutive nucleotides. Preferably YYY is all 2'-F modified nucleotides.

In one embodiment, the $N_a$ and/or $N_b$ comprise modifications of alternating pattern.

In one embodiment, the YYY motif occurs at or near the cleavage site of the sense strand. For example, when the RNAi agent has a duplex region of 17-23 nucleotides in length, the YYY motif can occur at or the vicinity of the cleavage site (e.g.: can occur at positions 6, 7, 8, 7, 8, 9, 8, 9, 10, 9, 10, 11, 10, 11, 12 or 11, 12, 13) of—the sense strand, the count starting from the 1st nucleotide, from the 5'-end; or optionally, the count starting at the 1st paired nucleotide within the duplex region, from the 5'-end.

In one embodiment, i is 1 and j is 0, or i is 0 and j is 1, or both i and j are 1. The sense strand can therefore be represented by the following formulas:

(Ib)

(Ic)

or

(Id)

When the sense strand is represented by formula (Ib), $N_b$ represents an oligonucleotide sequence comprising 0-10, 0-7, 0-5, 0-4, 0-2 or 0 modified nucleotides. Each $N_a$ independently can represent an oligonucleotide sequence comprising 2-20, 2-15, or 2-10 modified nucleotides.

When the sense strand is represented as formula (Ic), $N_b$ represents an oligonucleotide sequence comprising 0-10, 0-7, 0-10, 0-7, 0-5, 0-4, 0-2 or 0 modified nucleotides. Each $N_a$ can independently represent an oligonucleotide sequence comprising 2-20, 2-15, or 2-10 modified nucleotides.

When the sense strand is represented as formula (Id), each $N_b$ independently represents an oligonucleotide sequence comprising 0-10, 0-7, 0-5, 0-4, 0-2 or 0 modified nucleotides. Preferably, $N_b$ is 0, 1, 2, 3, 4, 5 or 6 Each $N_a$ can independently represent an oligonucleotide sequence comprising 2-20, 2-15, or 2-10 modified nucleotides. Each of X, Y and Z may be the same or different from each other.

In other embodiments, i is 0 and j is 0, and the sense strand may be represented by the formula:

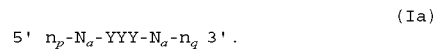
(Ia)

When the sense strand is represented by formula (Ia), each $N_a$ independently can represent an oligonucleotide sequence comprising 2-20, 2-15, or 2-10 modified nucleotides.

In one embodiment, the antisense strand sequence of the RNAi may be represented by formula (II):

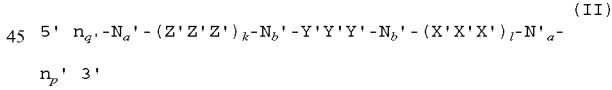
(II)

wherein:
k and l are each independently 0 or 1;
p' and q' are each independently 0-6;
each $N_a'$ independently represents an oligonucleotide sequence comprising 0-25 modified nucleotides, each sequence comprising at least two differently modified nucleotides;
each $N_b'$ independently represents an oligonucleotide sequence comprising 0-10 modified nucleotides;
each $n_p'$ and $n_q'$ independently represent an overhang nucleotide;
wherein $N_b'$ and Y' do not have the same modification; and
X'X'X', Y'Y'Y' and Z'Z'Z' each independently represent one motif of three identical modifications on three consecutive nucleotides.

In one embodiment, the $N_a'$ and/or $N_b'$ comprise modifications of alternating pattern.

The Y'Y'Y' motif occurs at or near the cleavage site of the antisense strand. For example, when the RNAi agent has a duplex region of 17-23 nucleotide in length, the Y'Y'Y' motif can occur at positions 9, 10, 11; 10, 11, 12; 11, 12, 13; 12, 13, 14; or 13, 14, 15 of the antisense strand, with the count starting from the 1$^{st}$ nucleotide, from the 5'-end; or optionally, the count starting at the 1$^{st}$ paired nucleotide within the duplex region, from the 5'-end. Preferably, the Y'Y'Y' motif occurs at positions 11, 12, 13.

In one embodiment, Y'Y'Y' motif is all 2'-OMe modified nucleotides.

In one embodiment, k is 1 and l is 0, or k is 0 and l is 1, or both k and l are 1.

The antisense strand can therefore be represented by the following formulas:

  (IIb)

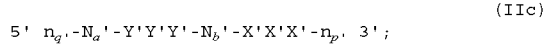  (IIc)

  (IId)

When the antisense strand is represented by formula (IIb), $N_b$ represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides.

When the antisense strand is represented as formula (IIc), $N_b'$ represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides.

When the antisense strand is represented as formula (IId), each $N_b'$ independently represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides. Preferably, $N_b$ is 0, 1, 2, 3, 4, 5 or 6.

In other embodiments, k is 0 and l is 0 and the antisense strand may be represented by the formula:

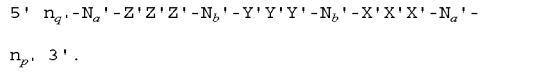  (Ia)

When the antisense strand is represented as formula (IIa), each $N_a'$ independently represents an oligonucleotide sequence comprising 2-20, 2-15, or 2-10 modified nucleotides. Each of X', Y' and Z' may be the same or different from each other.

Each nucleotide of the sense strand and antisense strand may be independently modified with LNA, CRN, UNA, cEt, HNA, CeNA, 2'-methoxyethyl, 2'-O-methyl, 2'-O-allyl, 2'-C-allyl, 2'-hydroxyl, or 2'-fluoro. For example, each nucleotide of the sense strand and antisense strand is independently modified with 2'-O-methyl or 2'-fluoro. Each X, Y, Z, X', Y' and Z', in particular, may represent a 2'-O-methyl modification or a 2'-fluoro modification.

In one embodiment, the sense strand of the RNAi agent may contain YYY motif occurring at 9, 10 and 11 positions of the strand when the duplex region is 21 nt, the count starting from the 1$^{st}$ nucleotide from the 5'-end, or optionally, the count starting at the 1$^{st}$ paired nucleotide within the duplex region, from the 5'-end; and Y represents 2'-F modification. The sense strand may additionally contain XXX motif or ZZZ motifs as wing modifications at the opposite end of the duplex region; and XXX and ZZZ each independently represents a 2'-OMe modification or 2'-F modification.

In one embodiment the antisense strand may contain Y'Y'Y' motif occurring at positions 11, 12, 13 of the strand, the count starting from the 1$^{st}$ nucleotide from the 5'-end, or optionally, the count starting at the 1$^{st}$ paired nucleotide within the duplex region, from the 5'-end; and Y' represents 2'-O-methyl modification. The antisense strand may additionally contain X'X'X' motif or Z'Z'Z' motifs as wing modifications at the opposite end of the duplex region; and X'X'X' and Z'Z'Z' each independently represents a 2'-OMe modification or 2'-F modification.

The sense strand represented by any one of the above formulas (Ia), (Ib), (Ic), and (Id) forms a duplex with a antisense strand being represented by any one of formulas (IIa), (IIb), (IIc), and (IId), respectively.

Accordingly, the RNAi agents for use in the methods of the invention may comprise a sense strand and an antisense strand, each strand having 14 to 30 nucleotides, the RNAi duplex represented by formula (III):

(III)
sense:
5' $n_p$-$N_a$-(X X X)$_i$-$N_b$-Y Y Y-$N_b$-(Z Z Z)$_j$-$N_a$-$n_q$ 3' antisense:
3' $n_p'$-$N_a'$-(X'X'X')$_k$-$N_b'$-Y'Y'Y'-$N_b'$-(Z'Z'Z')$_l$-$N_a'$-$n_q'$ 5' wherein:

j, k, and l are each independently 0 or 1;

p, p', q, and q' are each independently 0-6;

each $N_a$ and $N_a'$ independently represents an oligonucleotide sequence comprising 0-25 modified nucleotides, each sequence comprising at least two differently modified nucleotides;

each $N_b$ and $N_b'$ independently represents an oligonucleotide sequence comprising 0-10 modified nucleotides;

wherein each $n_p'$, $n_p$, $n_q'$, and $n_q$, each of which may or may not be present, independently represents an overhang nucleotide; and XXX, YYY, ZZZ, X'X'X', Y'Y'Y', and Z'Z'Z' each independently represent one motif of three identical modifications on three consecutive nucleotides.

In one embodiment, i is 0 and j is 0; or i is 1 and j is 0; or i is 0 and j is 1; or both i and j are 0; or both i and j are 1. In another embodiment, k is 0 and l is 0; or k is 1 and l is 0; k is 0 and l is 1; or both k and l are 0; or both k and l are 1.

Exemplary combinations of the sense strand and antisense strand forming a RNAi duplex include the formulas below:

(IIIa)
5' $n_p$-$N_a$-Y Y Y-$N_a$-$n_q$ 3'

3' $n_p'$-$N_a'$-Y'Y'Y'-$N_a'n_q'$ 5'

(IIIb)
5' $n_p$-$N_a$-Y Y Y-$N_b$-Z Z Z-$N_a$-$n_q$ 3'

3' $n_p'$-$N_a'$-Y'Y'Y'-$N_b'$-Z'Z'Z'-$N_a'n_q'$ 5'

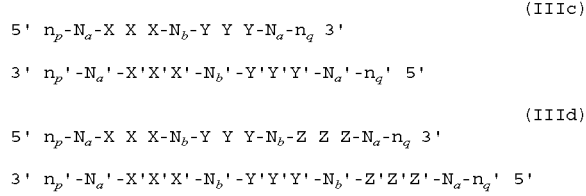

When the RNAi agent is represented by formula (IIIa), each $N_a$ independently represents an oligonucleotide sequence comprising 2-20, 2-15, or 2-10 modified nucleotides.

When the RNAi agent is represented by formula (IIIb), each $N_b$ independently represents an oligonucleotide sequence comprising 1-10, 1-7, 1-5 or 1-4 modified nucleotides. Each $N_a$ independently represents an oligonucleotide sequence comprising 2-20, 2-15, or 2-10 modified nucleotides.

When the RNAi agent is represented as formula (IIIc), each $N_b$, $N_b'$ independently represents an oligonucleotide sequence comprising 0-10, 0-7, 0-10, 0-7, 0-5, 0-4, 0-2 or 0 modified nucleotides. Each $N_a$ independently represents an oligonucleotide sequence comprising 2-20, 2-15, or 2-10 modified nucleotides.

When the RNAi agent is represented as formula (IIId), each $N_b$, $N_b'$ independently represents an oligonucleotide sequence comprising 0-10, 0-7, 0-10, 0-7, 0-5, 0-4, 0-2 or 0 modified nucleotides. Each $N_a$, $N_a'$ independently represents an oligonucleotide sequence comprising 2-20, 2-15, or 2-10 modified nucleotides. Each of $N_a$, $N_a'$, $N_b$ and $N_b'$ independently comprises modifications of alternating pattern.

Each of X, Y and Z in formulas (III), (IIIa), (IIIb), (IIIc), and (IIId) may be the same or different from each other.

When the RNAi agent is represented by formula (III), (IIIa), (IIIb), (IIIc), and (IIId), at least one of the Y nucleotides may form a base pair with one of the Y' nucleotides. Alternatively, at least two of the Y nucleotides form base pairs with the corresponding Y' nucleotides; or all three of the Y nucleotides all form base pairs with the corresponding Y' nucleotides.

When the RNAi agent is represented by formula (IIIb) or (IIId), at least one of the Z nucleotides may form a base pair with one of the Z' nucleotides. Alternatively, at least two of the Z nucleotides form base pairs with the corresponding Z' nucleotides; or all three of the Z nucleotides all form base pairs with the corresponding Z' nucleotides.

When the RNAi agent is represented as formula (IIIc) or (IIId), at least one of the X nucleotides may form a base pair with one of the X' nucleotides. Alternatively, at least two of the X nucleotides form base pairs with the corresponding X' nucleotides; or all three of the X nucleotides all form base pairs with the corresponding X' nucleotides.

In one embodiment, the modification on the Y nucleotide is different than the modification on the Y' nucleotide, the modification on the Z nucleotide is different than the modification on the Z' nucleotide, and/or the modification on the X nucleotide is different than the modification on the X' nucleotide.

In one embodiment, when the RNAi agent is represented by formula (IIId), the $N_a$ modifications are 2'-O-methyl or 2'-fluoro modifications. In another embodiment, when the RNAi agent is represented by formula (IIId), the $N_a$ modifications are 2'-O-methyl or 2'-fluoro modifications, $n_p'>0$ and at least one $n_p'$ is linked to a neighboring nucleotide a via phosphorothioate linkage. In yet another embodiment, when the RNAi agent is represented by formula (IIId), the $N_a$ modifications are 2'-O-methyl or 2'-fluoro modifications, $n_p'>0$ and at least one $n_p'$ is linked to a neighboring nucleotide via phosphorothioate linkage, and the sense strand is conjugated to one or more GalNAc derivatives attached through a bivalent or trivalent branched linker (described below). In another embodiment, when the RNAi agent is represented by formula (IIId), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In one embodiment, when the RNAi agent is represented by formula (IIIa), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In one embodiment, the RNAi agent is a multimer containing at least two duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, the RNAi agent is a multimer containing three, four, five, six or more duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, two RNAi agents represented by formula (III), (IIIa), (IIIb), (IIIc), and (IIId) are linked to each other at the 5' end, and one or both of the 3' ends and are optionally conjugated to a ligand. Each of the agents can target the same gene or two different genes; or each of the agents can target same gene at two different target sites.

Various publications describe multimeric RNAi agents that can be used in the methods of the invention. Such publications include WO2007/091269, U.S. Pat. No. 7,858,769, WO2010/141511, WO2007/117686, WO2009/014887 and WO2011/031520 the entire contents of each of which are hereby incorporated herein by reference.

As described in more detail below, the RNAi agent that contains conjugations of one or more carbohydrate moieties to a RNAi agent can optimize one or more properties of the RNAi agent. In many cases, the carbohydrate moiety will be attached to a modified subunit of the RNAi agent. For example, the ribose sugar of one or more ribonucleotide subunits of a dsRNA agent can be replaced with another moiety, e.g., a non-carbohydrate (preferably cyclic) carrier to which is attached a carbohydrate ligand. A ribonucleotide subunit in which the ribose sugar of the subunit has been so replaced is referred to herein as a ribose replacement modification subunit (RRMS). A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

The ligand may be attached to the polynucleotide via a carrier. The carriers include (i) at least one "backbone attachment point," preferably two "backbone attachment points" and (ii) at least one "tethering attachment point." A "backbone attachment point" as used herein refers to a functional group, e.g. a hydroxyl group, or generally, a bond available for, and that is suitable for incorporation of the carrier into the backbone, e.g., the phosphate, or modified phosphate, e.g., sulfur containing, backbone, of a ribonucleic acid. A "tethering attachment point" (TAP) in some embodiments refers to a constituent ring atom of the cyclic carrier, e.g., a carbon atom or a heteroatom (distinct from an atom which provides a backbone attachment point), that connects a selected moiety. The moiety can be, e.g., a carbohydrate, e.g. monosaccharide, disaccharide, trisaccharide, tetrasaccharide, oligosaccharide and polysaccharide. Optionally, the selected moiety is connected by an intervening tether to the cyclic carrier. Thus, the cyclic carrier will often include a functional group, e.g., an amino group, or generally, provide a bond, that is suitable for incorporation or tethering of another chemical entity, e.g., a ligand to the constituent ring.

The RNAi agents may be conjugated to a ligand via a carrier, wherein the carrier can be cyclic group or acyclic group; preferably, the cyclic group is selected from pyrrolidinyl, pyrazolinyl, pyrazolidinyl, imidazolinyl, imidazolidinyl, piperidinyl, piperazinyl, [1,3]dioxolane, oxazolidinyl, isoxazolidinyl, morpholinyl, thiazolidinyl, isothiazolidinyl, quinoxalinyl, pyridazinonyl, tetrahydrofuryl and decalin; preferably, the acyclic group is selected from serinol backbone or diethanolamine backbone.

In certain specific embodiments, the RNAi agent for use in the methods of the invention is an agent selected from the group of agents listed in any one of Tables 3-5, 7, and 8. These agents may further comprise a ligand.

IV. iRNAs Conjugated to Ligands

Another modification of the RNA of an iRNA of the invention involves chemically linking to the RNA one or more ligands, moieties or conjugates that enhance the activity, cellular distribution or cellular uptake of the iRNA. Such moieties include but are not limited to lipid moieties such as a cholesterol moiety (Letsinger et al., *Proc. Natl. Acid. Sci. USA*, 1989, 86: 6553-6556), cholic acid (Manoharan et al., *Biorg. Med. Chem. Let.*, 1994, 4:1053-1060), a thioether, e.g., beryl-S-tritylthiol (Manoharan et al., *Ann. N.Y. Acad. Sci.*, 1992, 660:306-309; Manoharan et al., *Biorg. Med. Chem. Let.*, 1993, 3:2765-2770), a thiocholesterol (Oberhauser et al., *Nucl. Acids Res.*, 1992, 20:533-538), an aliphatic chain, e.g., dodecandiol or undecyl residues (Saison-Behmoaras et al., *EMBO J*, 1991, 10:1111-1118; Kabanov et al., *FEBS Lett.*, 1990, 259:327-330; Svinarchuk et al., *Biochimie*, 1993, 75:49-54), a phospholipid, e.g., di-hexadecyl-rac-glycerol or triethyl-ammonium 1,2-di-O-hexadecyl-rac-glycero-3-phosphonate (Manoharan et al., *Tetrahedron Lett.*, 1995, 36:3651-3654; Shea et al., *Nucl. Acids Res.*, 1990, 18:3777-3783), a polyamine or a polyethylene glycol chain (Manoharan et al., *Nucleosides & Nucleotides*, 1995, 14:969-973), or adamantane acetic acid (Manoharan et al., *Tetrahedron Lett.*, 1995, 36:3651-3654), a palmityl moiety (Mishra et al., *Biochim. Biophys. Acta*, 1995, 1264:229-237), or an octadecylamine or hexylamino-carbonyloxycholesterol moiety (Crooke et al., *J. Pharmacol. Exp. Ther.*, 1996, 277:923-937).

In one embodiment, a ligand alters the distribution, targeting or lifetime of an iRNA agent into which it is incorporated. In preferred embodiments a ligand provides an enhanced affinity for a selected target, e.g., molecule, cell or cell type, compartment, e.g., a cellular or organ compartment, tissue, organ or region of the body, as, e.g., compared to a species absent such a ligand. Preferred ligands will not take part in duplex pairing in a duplexed nucleic acid.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin, N-acetylgalactosamine, or hyaluronic acid); or a lipid. The ligand can also be a recombinant or synthetic molecule, such as a synthetic polymer, e.g., a synthetic polyamino acid. Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly(2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-gulucoseamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, vitamin A, biotin, or an RGD peptide or RGD peptide mimetic.

Other examples of ligands include dyes, intercalating agents (e.g. acridines), cross-linkers (e.g. psoralen, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g., cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, [MPEG]$_2$, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a hepatic cell. Ligands can also include hormones and hormone receptors. They can also include non-peptidic species, such as lipids, lectins, carbohydrates, vitamins, cofactors, multivalent lactose, multivalent galactose, N-acetyl-galactosamine, N-acetyl-gulucosamine multivalent mannose, or multivalent fucose. The ligand can be, for example, a lipopolysaccharide, an activator of p38 MAP kinase, or an activator of NF-κB.

The ligand can be a substance, e.g., a drug, which can increase the uptake of the iRNA agent into the cell, for example, by disrupting the cell's cytoskeleton, e.g., by disrupting the cell's microtubules, microfilaments, and/or intermediate filaments. The drug can be, for example, taxon, vincristine, vinblastine, cytochalasin, nocodazole, japlakinolide, latrunculin A, phalloidin, swinholide A, indanocine, or myoservin.

In some embodiments, a ligand attached to an iRNA as described herein acts as a pharmacokinetic modulator (PK modulator). PK modulators include lipophiles, bile acids, steroids, phospholipid analogues, peptides, protein binding agents, PEG, vitamins etc. Exemplary PK modulators include, but are not limited to, cholesterol, fatty acids, cholic acid, lithocholic acid, dialkylglycerides, diacylglyceride, phospholipids, sphingolipids, naproxen, ibuprofen, vitamin E, biotin etc. Oligonucleotides that comprise a number of phosphorothioate linkages are also known to bind to serum protein, thus short oligonucleotides, e.g., oligonucleotides of about 5 bases, 10 bases, 15 bases or 20 bases, comprising multiple of phosphorothioate linkages in the backbone are also amenable to the present invention as ligands (e.g. as PK modulating ligands). In addition, aptamers that bind serum components (e.g. serum proteins) are also suitable for use as PK modulating ligands in the embodiments described herein.

Ligand-conjugated oligonucleotides of the invention may be synthesized by the use of an oligonucleotide that bears a pendant reactive functionality, such as that derived from the attachment of a linking molecule onto the oligonucleotide (described below). This reactive oligonucleotide may be reacted directly with commercially-available ligands, ligands that are synthesized bearing any of a variety of protecting groups, or ligands that have a linking moiety attached thereto.

The oligonucleotides used in the conjugates of the present invention may be conveniently and routinely made through the well-known technique of solid-phase synthesis. Equipment for such synthesis is sold by several vendors including, for example, Applied Biosystems (Foster City, Calif.). Any other means for such synthesis known in the art may additionally or alternatively be employed. It is also known to use similar techniques to prepare other oligonucleotides, such as the phosphorothioates and alkylated derivatives.

In the ligand-conjugated oligonucleotides and ligand-molecule bearing sequence-specific linked nucleosides of the present invention, the oligonucleotides and oligonucleosides may be assembled on a suitable DNA synthesizer utilizing standard nucleotide or nucleoside precursors, or nucleotide or nucleoside conjugate precursors that already bear the linking moiety, ligand-nucleotide or nucleoside-conjugate precursors that already bear the ligand molecule, or non-nucleoside ligand-bearing building blocks.

When using nucleotide-conjugate precursors that already bear a linking moiety, the synthesis of the sequence-specific linked nucleosides is typically completed, and the ligand molecule is then reacted with the linking moiety to form the ligand-conjugated oligonucleotide. In some embodiments, the oligonucleotides or linked nucleosides of the present invention are synthesized by an automated synthesizer using phosphoramidites derived from ligand-nucleoside conjugates in addition to the standard phosphoramidites and non-standard phosphoramidites that are commercially available and routinely used in oligonucleotide synthesis.

A. Lipid Conjugates

In one embodiment, the ligand or conjugate is a lipid or lipid-based molecule. Such a lipid or lipid-based molecule preferably binds a serum protein, e.g., human serum albumin (HSA). An HSA binding ligand allows for distribution of the conjugate to a target tissue, e.g., a non-kidney target tissue of the body. For example, the target tissue can be the liver, including parenchymal cells of the liver. Other molecules that can bind HSA can also be used as ligands. For example, naproxen or aspirin can be used. A lipid or lipid-based ligand can (a) increase resistance to degradation of the conjugate, (b) increase targeting or transport into a target cell or cell membrane, and/or (c) can be used to adjust binding to a serum protein, e.g., HSA.

A lipid based ligand can be used to inhibit, e.g., control the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

In a preferred embodiment, the lipid based ligand binds HSA. Preferably, it binds HSA with a sufficient affinity such that the conjugate will be preferably distributed to a non-kidney tissue. However, it is preferred that the affinity not be so strong that the HSA-ligand binding cannot be reversed.

In another preferred embodiment, the lipid based ligand binds HSA weakly or not at all, such that the conjugate will be preferably distributed to the kidney. Other moieties that target to kidney cells can also be used in place of or in addition to the lipid based ligand.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include are B vitamin, e.g., folic acid, B12, riboflavin, biotin, pyridoxal or other vitamins or nutrients taken up by target cells such as liver cells. Also included are HSA and low density lipoprotein (LDL).

B. Cell Permeation Agents

In another aspect, the ligand is a cell-permeation agent, preferably a helical cell-permeation agent. Preferably, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. The helical agent is preferably an alpha-helical agent, which preferably has a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The attachment of peptide and peptidomimetics to iRNA agents can affect pharmacokinetic distribution of the iRNA, such as by enhancing cellular recognition and absorption. The peptide or peptidomimetic moiety can be about 5-50 amino acids long, e.g., about 5, 10, 15, 20, 25, 30, 35, 40, 45, or 50 amino acids long.

A peptide or peptidomimetic can be, for example, a cell permeation peptide, cationic peptide, amphipathic peptide, or hydrophobic peptide (e.g., consisting primarily of Tyr, Trp or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVLLALLAP (SEQ ID NO: 13). An RFGF analogue (e.g., amino acid sequence AALLPVLLAAP (SEQ ID NO: 14) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ (SEQ ID NO: 15) and the Drosophila Antennapedia protein (RQIKIWFQNRRMK-WKK (SEQ ID NO: 16) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., Nature, 354:82-84, 1991). Examples of a peptide or peptidomimetic tethered to a dsRNA agent via an incorporated monomer unit for cell targeting purposes is an arginine-glycine-aspartic acid (RGD)-peptide, or RGD mimic A peptide moiety can range in length from about 5 amino acids to about 40 amino acids. The peptide moieties can have a structural modification, such as to increase stability or direct conformational properties. Any of the structural modifications described below can be utilized.

An RGD peptide for use in the compositions and methods of the invention may be linear or cyclic, and may be modified, e.g., glycosylated or methylated, to facilitate targeting to a specific tissue(s). RGD-containing peptides and peptidiomimemtics may include D-amino acids, as well as synthetic RGD mimics. In addition to RGD, one can use other moieties that target the integrin ligand. Preferred conjugates of this ligand target PECAM-1 or VEGF.

A "cell permeation peptide" is capable of permeating a cell, e.g., a microbial cell, such as a bacterial or fungal cell, or a mammalian cell, such as a human cell. A microbial cell-permeating peptide can be, for example, an α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., Nucl. Acids Res. 31:2717-2724, 2003).

C. Carbohydrate Conjugates

In some embodiments of the compositions and methods of the invention, an iRNA oligonucleotide further comprises a carbohydrate. The carbohydrate conjugated iRNA are advantageous for the in vivo delivery of nucleic acids, as well as compositions suitable for in vivo therapeutic use, as described herein. As used herein, "carbohydrate" refers to a compound which is either a carbohydrate per se made up of one or more monosaccharide units having at least 6 carbon atoms (which can be linear, branched or cyclic) with an oxygen, nitrogen or sulfur atom bonded to each carbon atom; or a compound having as a part thereof a carbohydrate moiety made up of one or more monosaccharide units each having at least six carbon atoms (which can be linear, branched or cyclic), with an oxygen, nitrogen or sulfur atom bonded to each carbon atom. Representative carbohydrates include the sugars (mono-, di-, tri- and oligosaccharides containing from about 4, 5, 6, 7, 8, or 9 monosaccharide units), and polysaccharides such as starches, glycogen, cellulose and polysaccharide gums. Specific monosaccharides include HBV and above (e.g., HBV, C6, C7, or C8) sugars; di- and trisaccharides include sugars having two or three monosaccharide units (e.g., HBV, C6, C7, or C8).

In one embodiment, a carbohydrate conjugate for use in the compositions and methods of the invention is a monosaccharide. In one embodiment, the monosaccharide is an N-acetylgalactosamine, such as

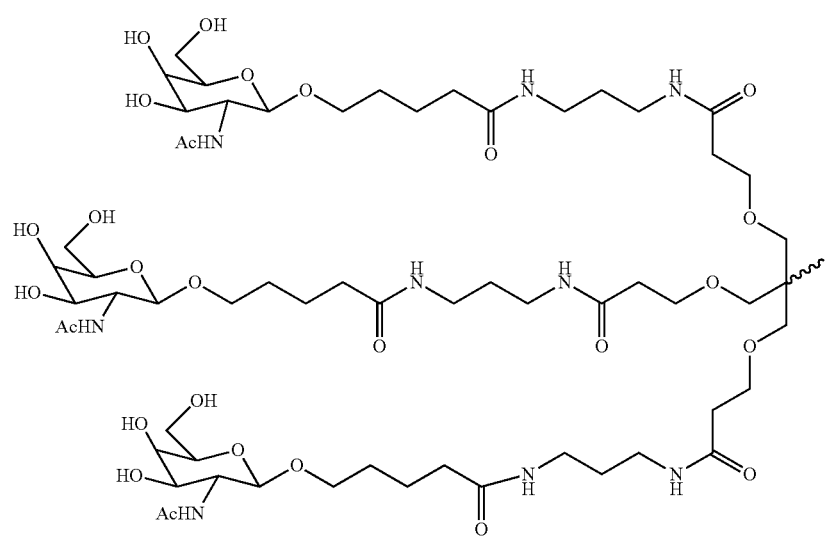

Formula II

In another embodiment, a carbohydrate conjugate for use in the compositions and methods of the invention is selected from the group consisting of:
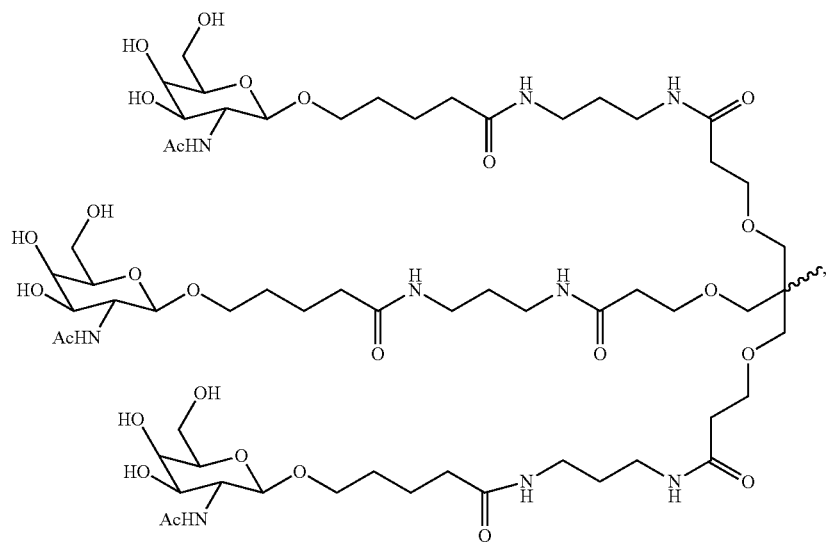
Formula II
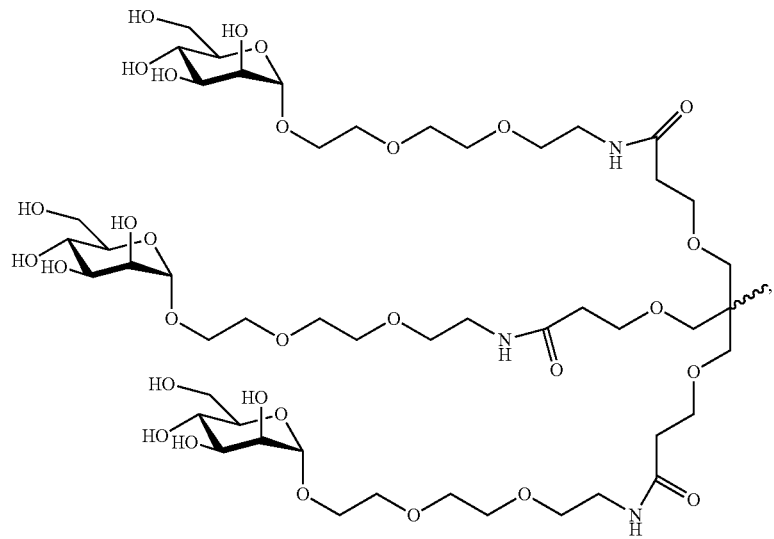
Formula III
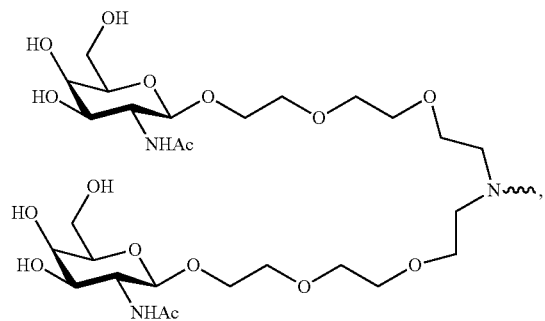
Formula IV -continued
Formula V
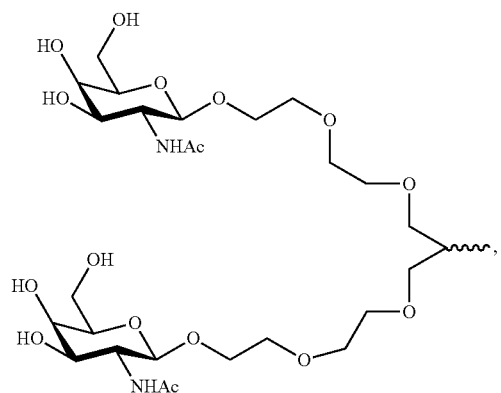
Formula VI
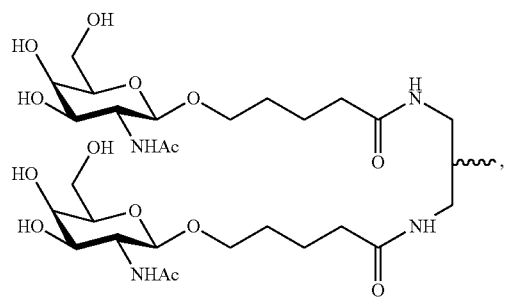
Formula VII
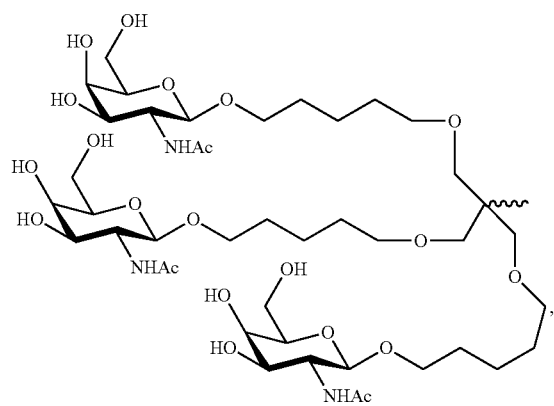
Formula VIII
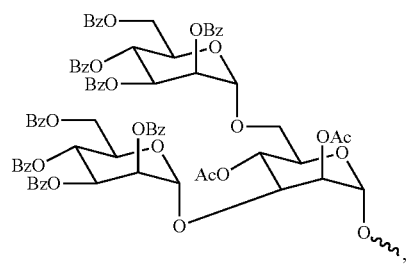
Formula IX
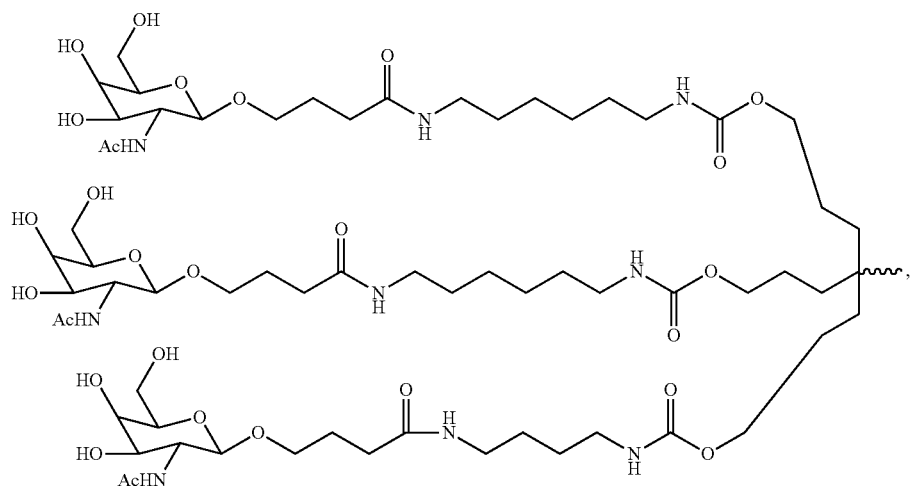

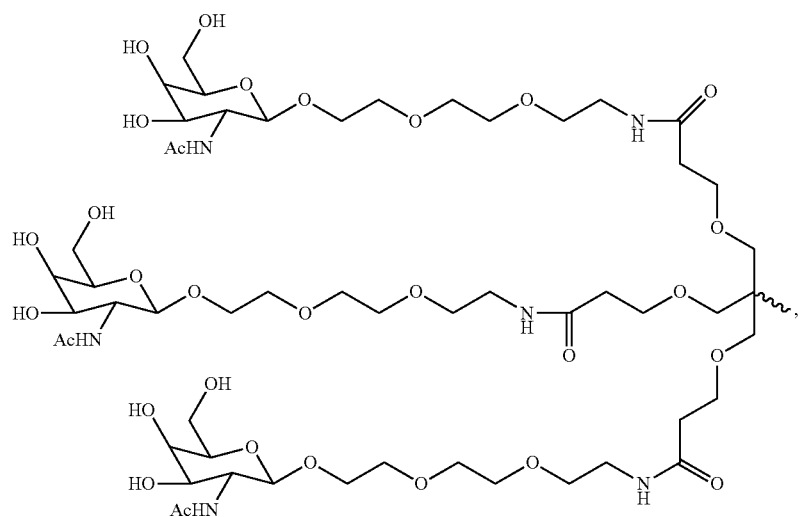
Formula X
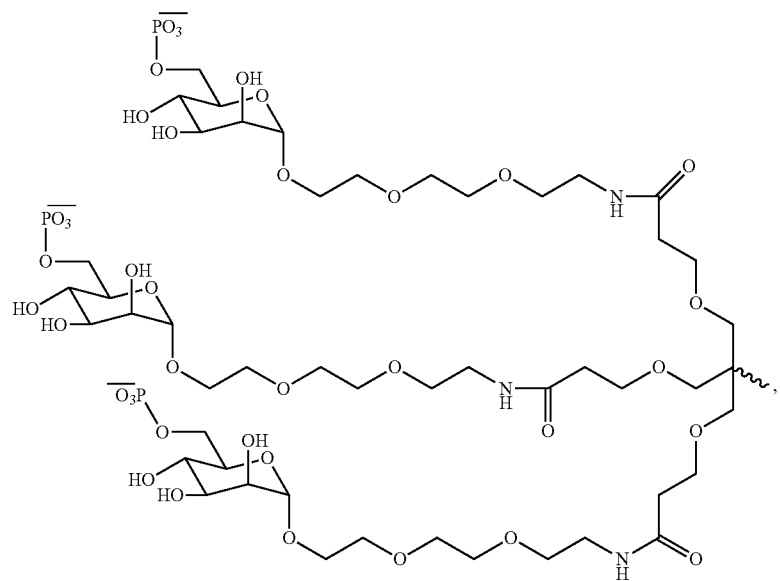
Formula XI

Formula XII
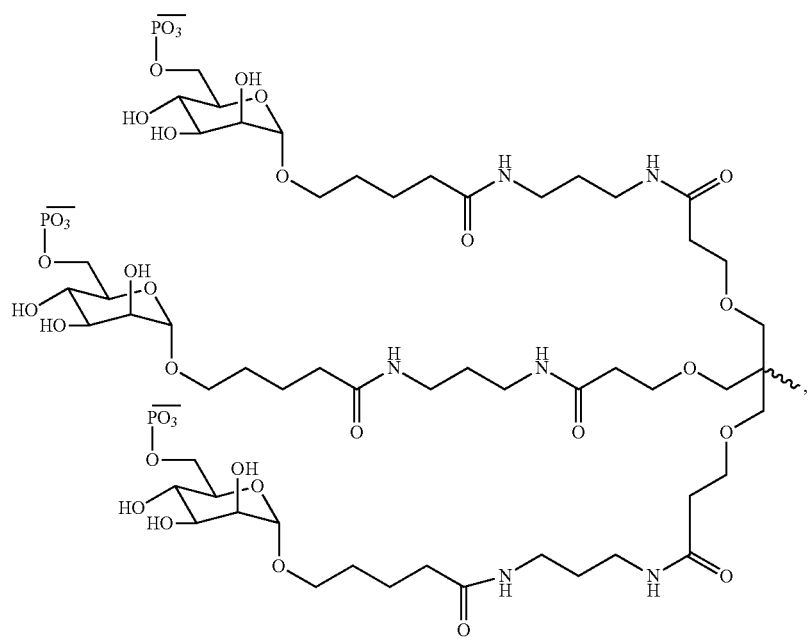
Formula XIII
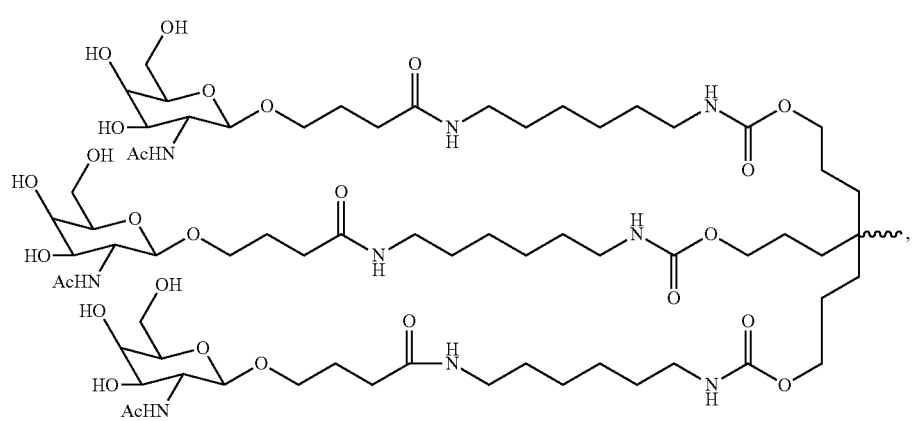
Formula XIV
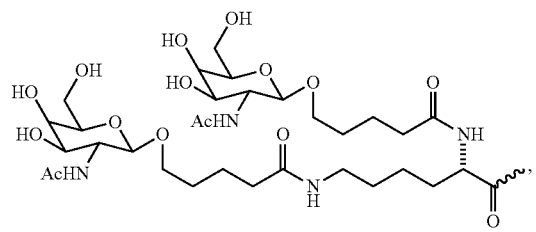
Formula XV
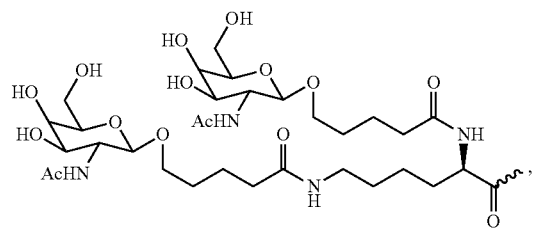
Formula XVI
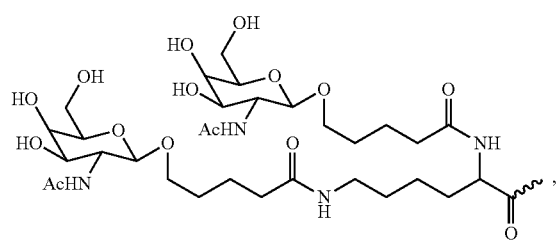
Formula XVII
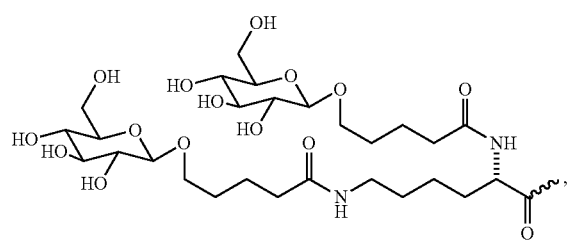

Formula XVIII
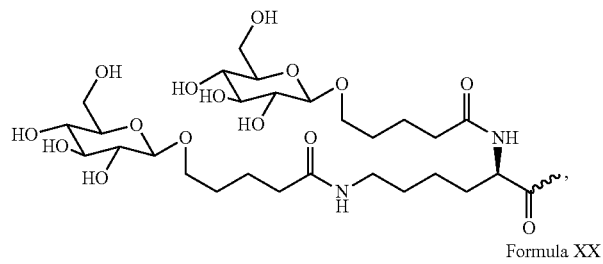
Formula XIX
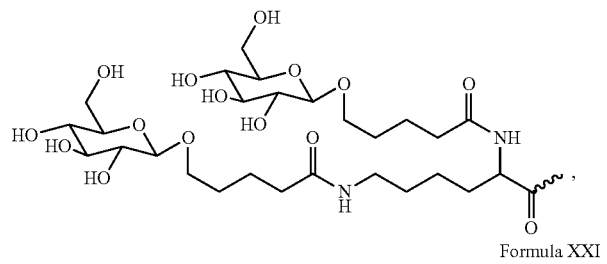
Formula XX
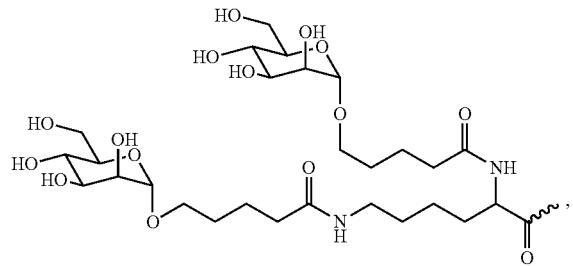
Formula XXI
Formula XXII
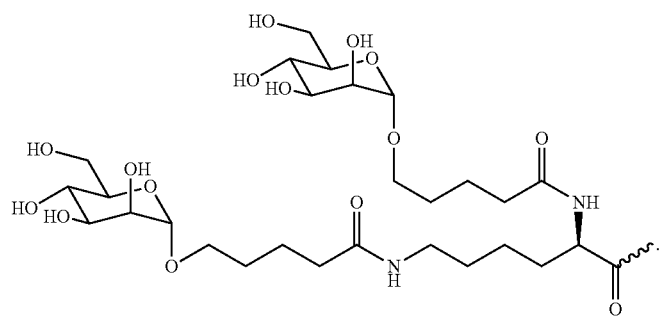
Another representative carbohydrate conjugate for use in the embodiments described herein includes, but is not limited to,
(Formula XXIII)
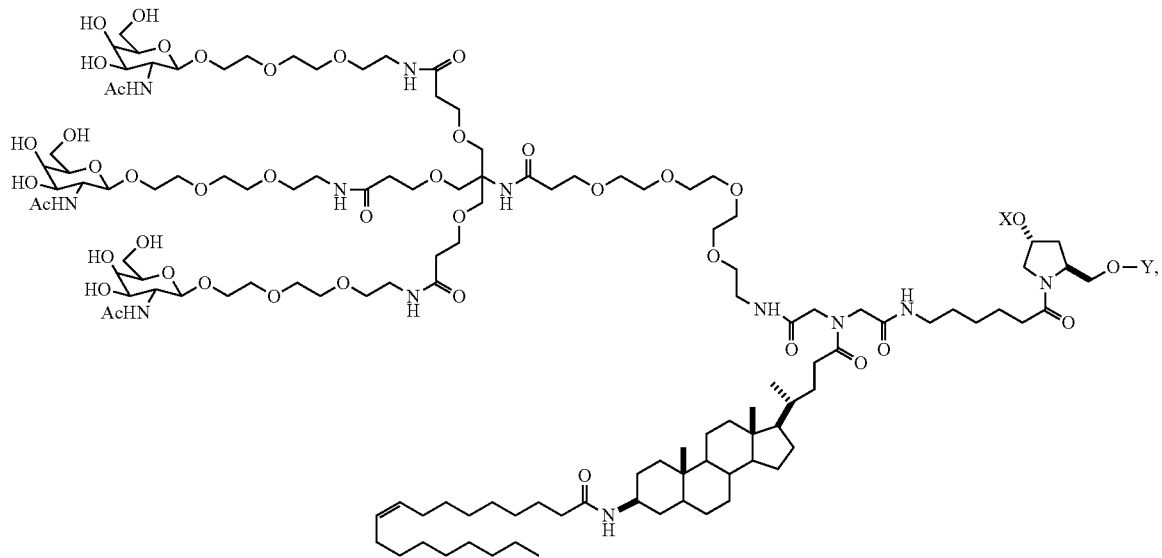

when one of X or Y is an oligonucleotide, the other is a hydrogen.

In some embodiments, the carbohydrate conjugate further comprises one or more additional ligands as described above, such as, but not limited to, a PK modulator and/or a cell permeation peptide.

Additional carbohydrate conjugates suitable for use in the present invention include those described in PCT Publication Nos. WO 2014/179620 and WO 2014/179627, the entire contents of each of which are incorporated herein by reference.

D. Linkers

In some embodiments, the conjugate or ligand described herein can be attached to an iRNA oligonucleotide with various linkers that can be cleavable or non-cleavable.

The term "linker" or "linking group" means an organic moiety that connects two parts of a compound, e.g., covalently attaches two parts of a compound. Linkers typically comprise a direct bond or an atom such as oxygen or sulfur, a unit such as NR8, C(O), C(O)NH, SO, $SO_2$, $SO_2$NH or a chain of atoms, such as, but not limited to, substituted or unsubstituted alkyl, substituted or unsubstituted alkenyl, substituted or unsubstituted alkynyl, arylalkyl, arylalkenyl, arylalkynyl, heteroarylalkyl, heteroarylalkenyl, heteroarylalkynyl, heterocyclylalkyl, heterocyclylalkenyl, heterocyclylalkynyl, aryl, heteroaryl, heterocyclyl, cycloalkyl, cycloalkenyl, alkylarylalkyl, alkylarylalkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynylheteroarylalkyl, alkynylheteroarylalkenyl, alkynylheteroarylalkynyl, alkylheterocyclylalkyl, alkylheterocyclylalkenyl, alkylhererocyclylalkynyl, alkenylheterocyclylalkyl, alkenylheterocyclylalkenyl, alkenylheterocyclylalkynyl, alkynylheterocyclylalkyl, alkynylheterocyclylalkenyl, alkynylheterocyclylalkynyl, alkylaryl, alkenylaryl, alkynylaryl, alkylheteroaryl, alkenylheteroaryl, alkynylhereroaryl, which one or more methylenes can be interrupted or terminated by O, S, S(O), $SO_2$, N(R8), C(O), substituted or unsubstituted aryl, substituted or unsubstituted heteroaryl, substituted or unsubstituted heterocyclic; where R8 is hydrogen, acyl, aliphatic or substituted aliphatic. In one embodiment, the linker is between about 1-24 atoms, 2-24, 3-24, 4-24, 5-24, 6-24, 6-18, 7-18, 8-18 atoms, 7-17, 8-17, 6-16, 7-16, or 8-16 atoms.

A cleavable linking group is one which is sufficiently stable outside the cell, but which upon entry into a target cell is cleaved to release the two parts the linker is holding together. In a preferred embodiment, the cleavable linking group is cleaved at least about 10 times, 20, times, 30 times, 40 times, 50 times, 60 times, 70 times, 80 times, 90 times or more, or at least about 100 times faster in a target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a preferred pH, thereby releasing a cationic lipid from the ligand inside the cell, or into the desired compartment of the cell.

A linker can include a cleavable linking group that is cleavable by a particular enzyme. The type of cleavable linking group incorporated into a linker can depend on the cell to be targeted. For example, a liver-targeting ligand can be linked to a cationic lipid through a linker that includes an ester group. Liver cells are rich in esterases, and therefore the linker will be cleaved more efficiently in liver cells than in cell types that are not esterase-rich. Other cell-types rich in esterases include cells of the lung, renal cortex, and testis.

Linkers that contain peptide bonds can be used when targeting cell types rich in peptidases, such as liver cells and synoviocytes.

In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus, one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It can be useful to make initial evaluations in cell-free or culture conditions and to confirm by further evaluations in whole animals. In preferred embodiments, useful candidate compounds are cleaved at least about 2, 4, 10, 20, 30, 40, 50, 60, 70, 80, 90, or about 100 times faster in the cell (or under in vitro conditions selected to mimic intracellular conditions) as compared to blood or serum (or under in vitro conditions selected to mimic extracellular conditions).

i. Redox Cleavable Linking Groups

In one embodiment, a cleavable linking group is a redox cleavable linking group that is cleaved upon reduction or oxidation. An example of reductively cleavable linking group is a disulphide linking group (—S—S—). To determine if a candidate cleavable linking group is a suitable "reductively cleavable linking group," or for example is suitable for use with a particular iRNA moiety and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In one, candidate compounds are cleaved by at most about 10% in the blood. In other embodiments, useful candidate compounds are degraded at least about 2, 4, 10, 20, 30, 40, 50, 60, 70, 80, 90, or about 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

ii. Phosphate-Based Cleavable Linking Groups

In another embodiment, a cleavable linker comprises a phosphate-based cleavable linking group. A phosphate-based cleavable linking group is cleaved by agents that degrade or hydrolyze the phosphate group. An example of an agent that cleaves phosphate groups in cells are enzymes such as phosphatases in cells. Examples of phosphate-based linking groups are —O—P(O)(ORk)-O—, —O—P(S)(ORk)-O—, —O—P(S)(SRk)-O—, —S—P(O)(ORk)-O—, —O—P(O)(ORk)-S—, —S—P(O)(ORk)-S—, —O—P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S—. Preferred embodiments are —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O, —S—P(S)(H)—O—, —S—P(O)(H)—S—, —O—P(S)(H)—S—. A preferred embodiment is —O—P(O)(OH)—O—. These candidates can be evaluated using methods analogous to those described above.

iii. Acid Cleavable Linking Groups

In another embodiment, a cleavable linker comprises an acid cleavable linking group. An acid cleavable linking group is a linking group that is cleaved under acidic conditions. In preferred embodiments acid cleavable linking groups are cleaved in an acidic environment with a pH of about 6.5 or lower (e.g., about 6.0, 5.75, 5.5, 5.25, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C=NN—, C(O)O, or —OC(O). A preferred embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

iv. Ester-Based Linking Groups

In another embodiment, a cleavable linker comprises an ester-based cleavable linking group. An ester-based cleavable linking group is cleaved by enzymes such as esterases and amidases in cells. Examples of ester-based cleavable linking groups include but are not limited to esters of alkylene, alkenylene and alkynylene groups. Ester cleavable linking groups have the general formula —C(O)O—, or —OC(O)—. These candidates can be evaluated using methods analogous to those described above.

v. Peptide-Based Cleaving Groups

In yet another embodiment, a cleavable linker comprises a peptide-based cleavable linking group. A peptide-based cleavable linking group is cleaved by enzymes such as peptidases and proteases in cells. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynelene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula —NHCHRAC(O)NHCHRBC(O)—, where RA and RB are the R groups of the two adjacent amino acids. These candidates can be evaluated using methods analogous to those described above.

In one embodiment, an iRNA of the invention is conjugated to a carbohydrate through a linker. Non-limiting examples of iRNA carbohydrate conjugates with linkers of the compositions and methods of the invention include, but are not limited to, (Formua XXIV)

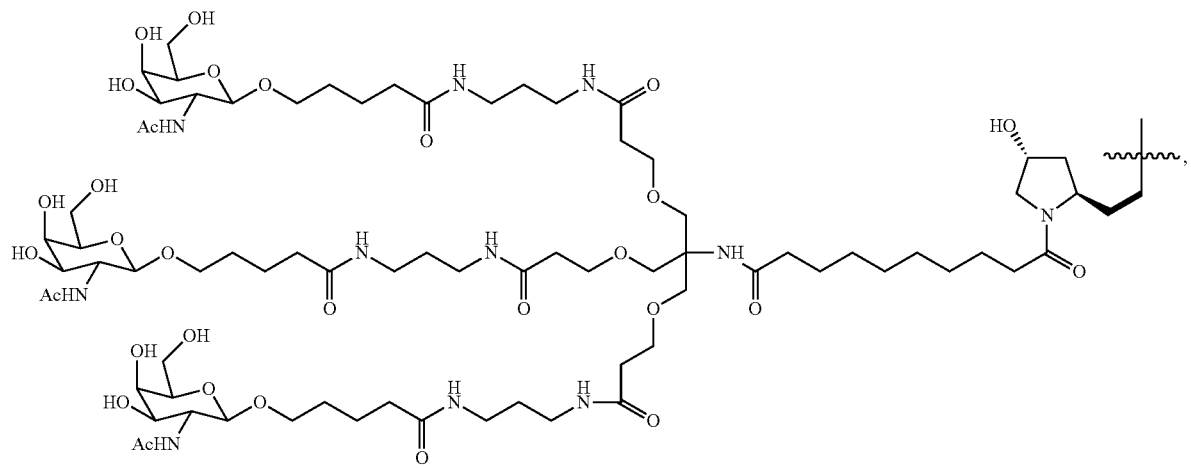

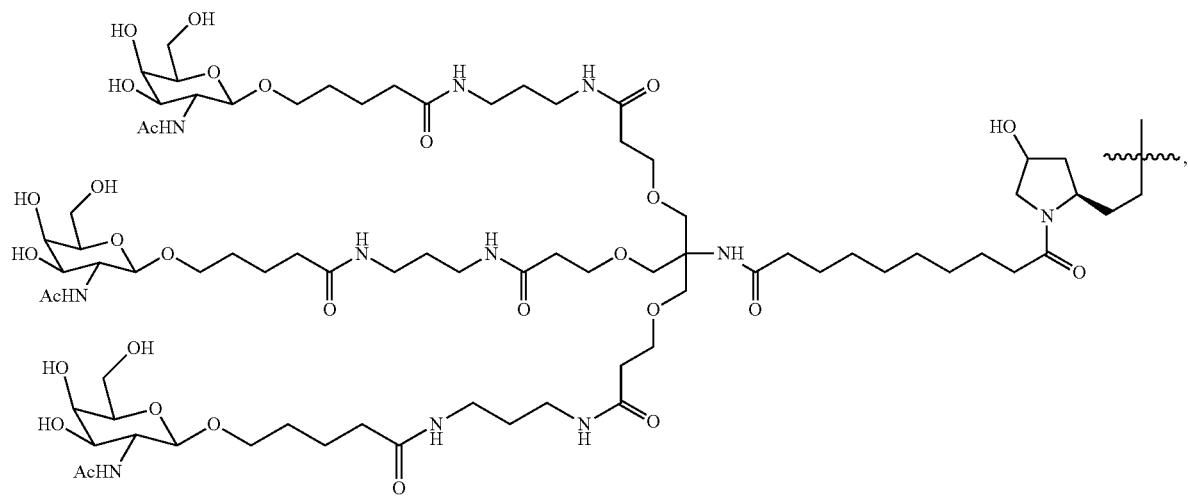
(Formula XXV)
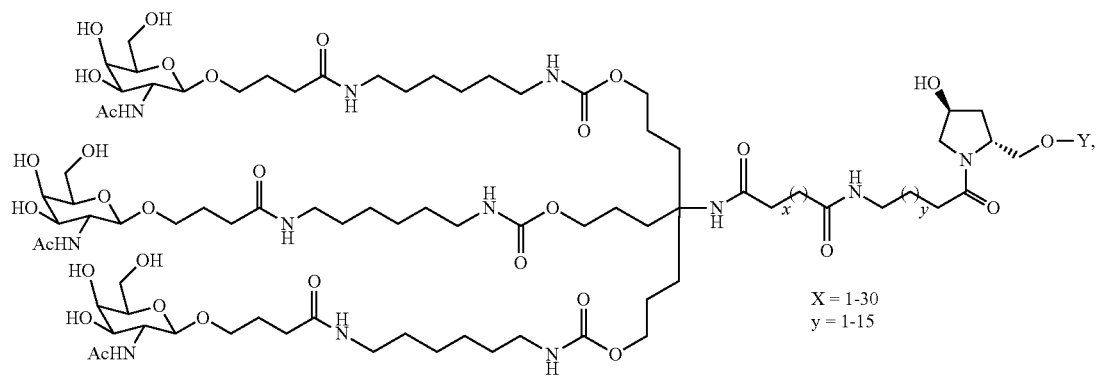
(Formula XXVI)
X = 1-30
y = 1-15
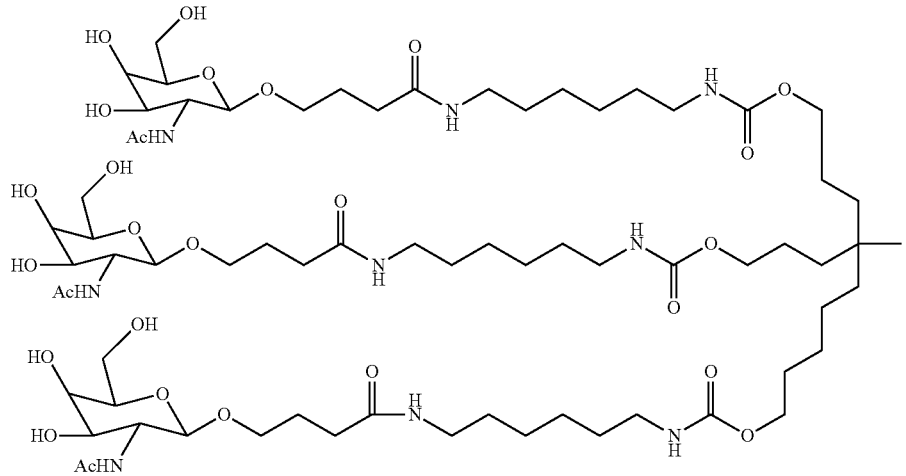
(Formula XXVII)

-continued
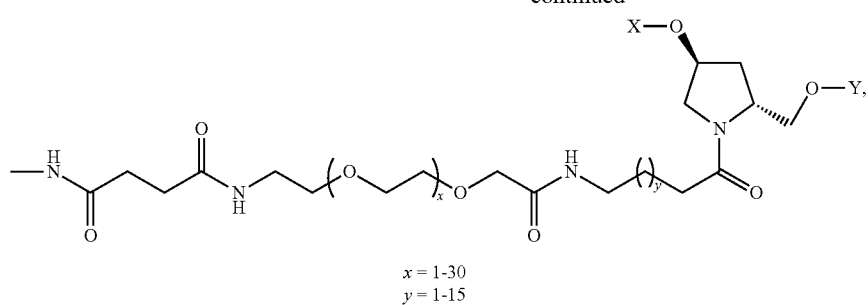
x = 1-30
y = 1-15
(Formula XXVIII)
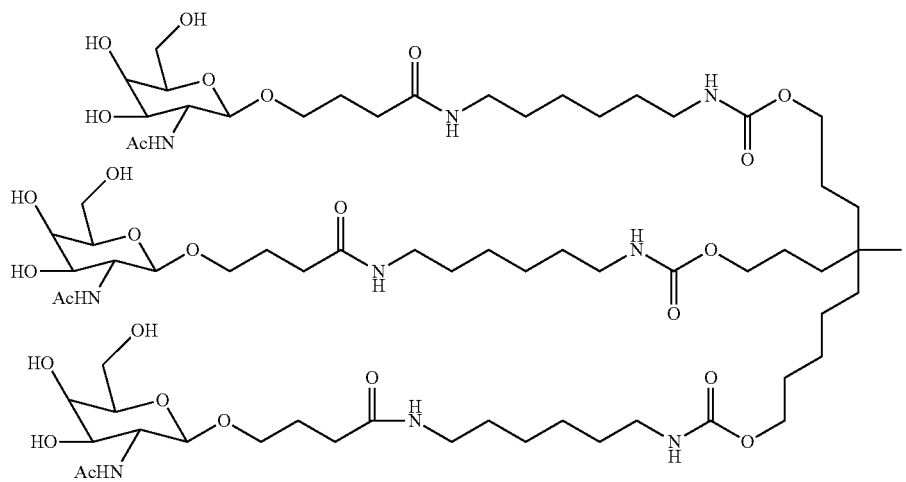
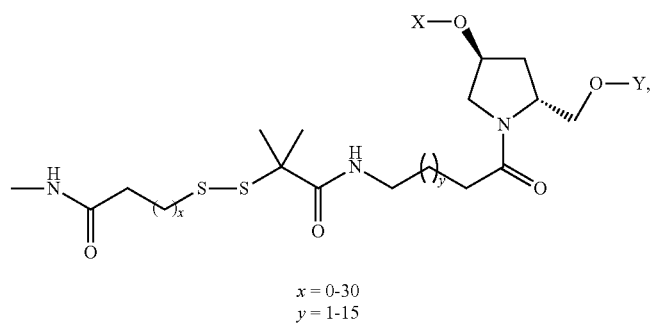
x = 0-30
y = 1-15
(Formula XXIX)
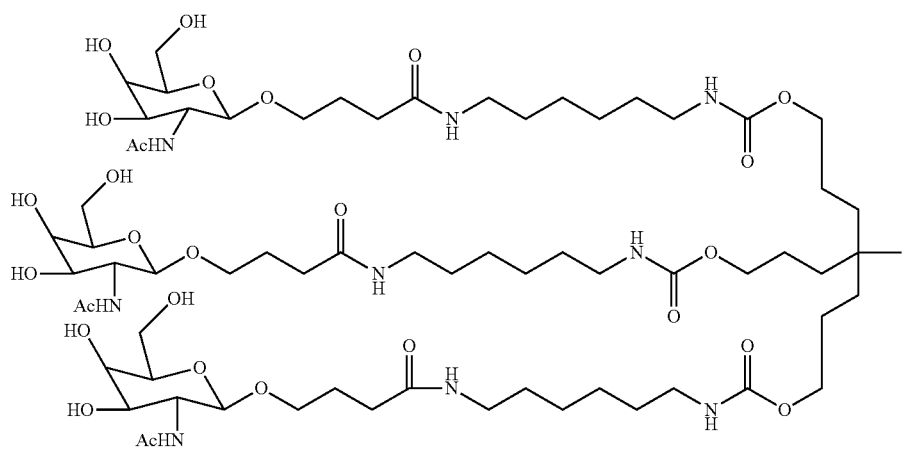

-continued
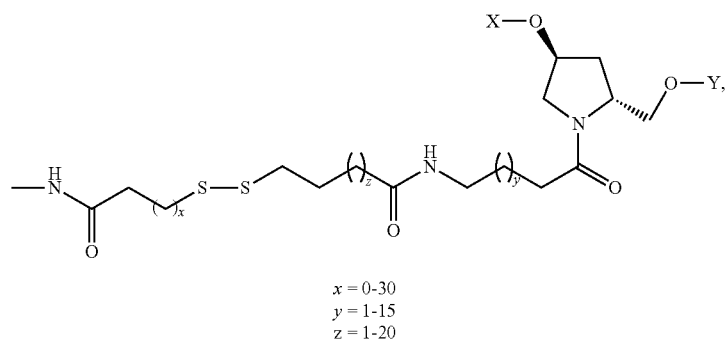
x = 0-30
y = 1-15
z = 1-20
(Formula XXX)
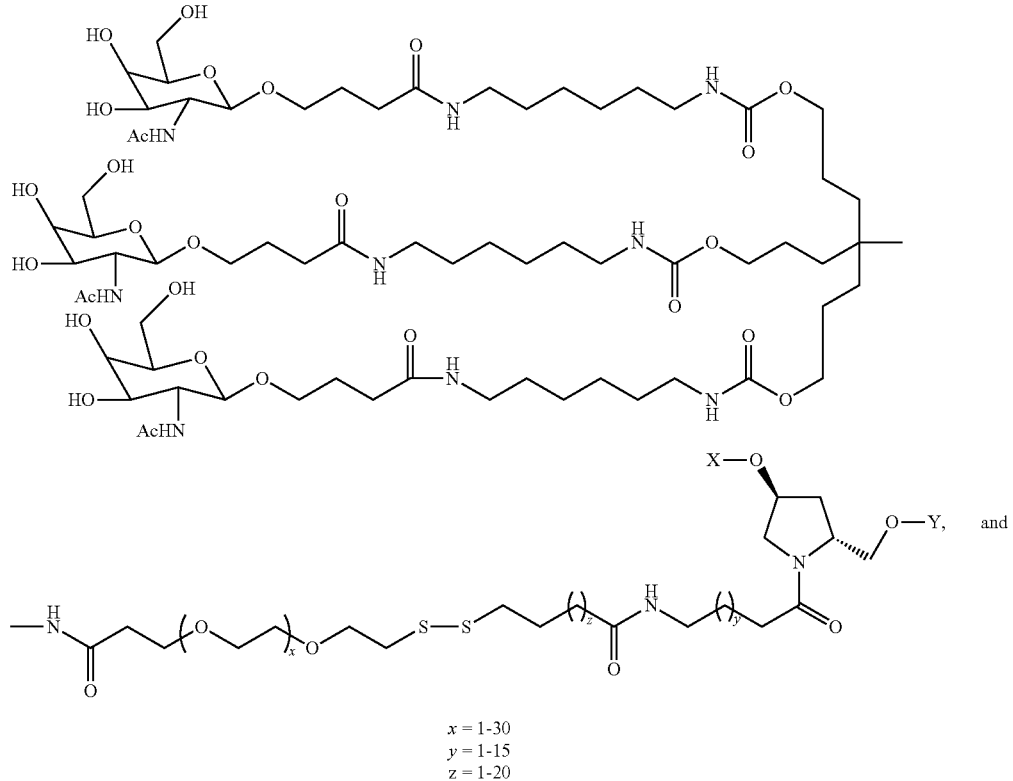
x = 1-30
y = 1-15
z = 1-20
(Formula XXXI)
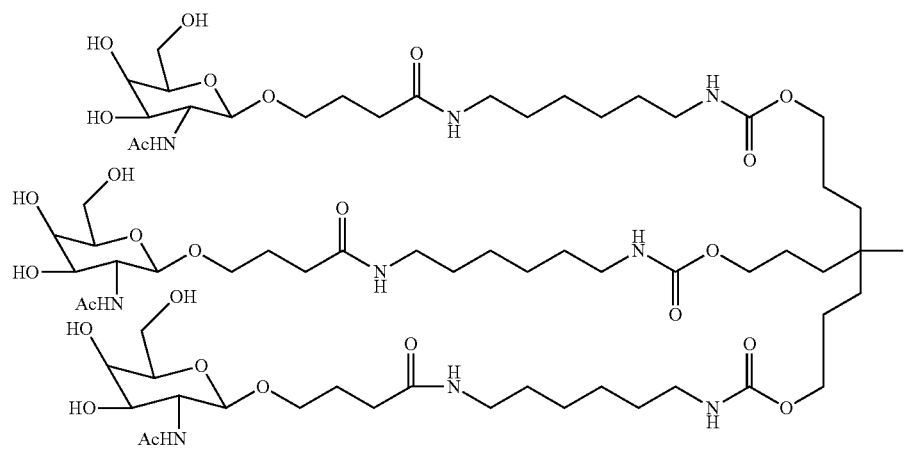

-continued

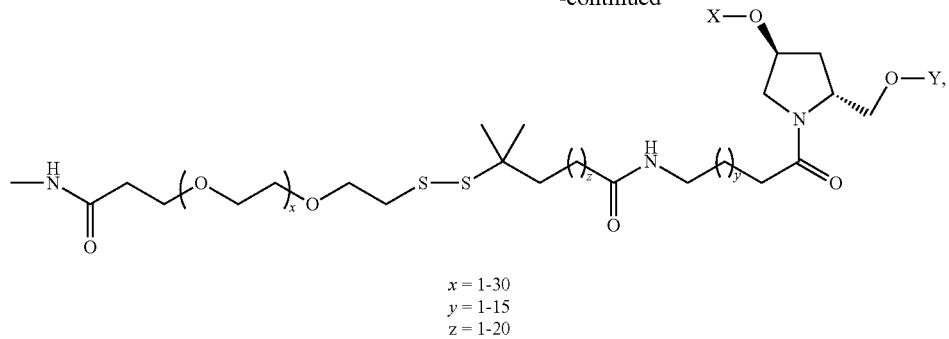

x = 1-30
y = 1-15
z = 1-20 and
when one of X or Y is an oligonucleotide, the other is a hydrogen.

In certain embodiments of the compositions and methods of the invention, a ligand is one or more "GalNAc" (N-acetylgalactosamine) derivatives attached through a bivalent or trivalent branched linker.

In one embodiment, a dsRNA of the invention is conjugated to a bivalent or trivalent branched linker selected from the group of structures shown in any of formula (XXXII)-(XXXV):

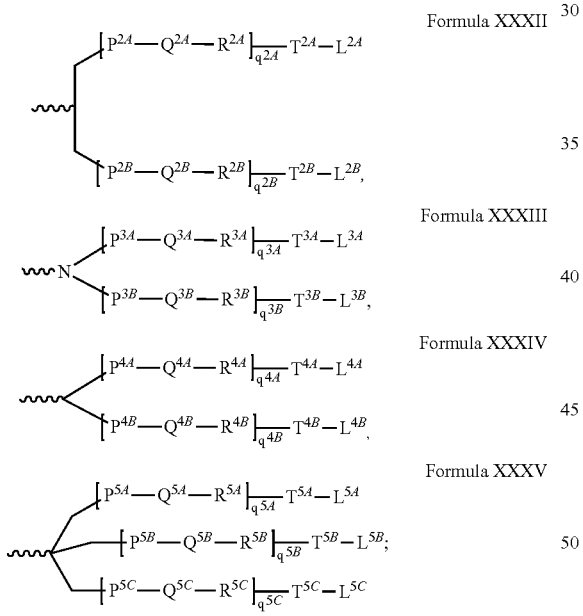

Formula XXXII

Formula XXXIII

Formula XXXIV

Formula XXXV wherein:
q2A, q2B, q3A, q3B, q4A, q4B, q5A, q5B and q5C represent independently for each occurrence 0-20 and wherein the repeating unit can be the same or different;

$P^{2A}$, $P^{2B}$, $P^{3A}$, $P^{3B}$, $P^{4A}$, $P^{4B}$, $P^{5A}$, $P^{5B}$, $P^{5C}$, $T^{2A}$, $T^{2B}$, $T^{3A}$, $T^{3B}$, $T^{4A}$, $T^{4B}$, $T^{4A}$, $T^{5B}$, $T^{5C}$ are each independently for each occurrence absent, CO, NH, O, S, OC(O), NHC(O), $CH_2$, $CH_2NH$ or $CH_2O$;

$Q^{2A}$, $Q^{2B}$, $Q^{3A}$, $Q^{3B}$, $Q^{4A}$, $Q^{4B}$, $Q^{5A}$, $Q^{5B}$, $Q^{5C}$ are independently for each occurrence absent, alkylene, substituted alkylene wherein one or more methylenes can be interrupted or terminated by one or more of O, S, S(O), $SO_2$, $N(R^N)$, $C(R')=C(R'')$, $C\equiv C$ or $C(O)$;

$R^{2A}$, $R^{2B}$, $R^{3A}$, $R^{3B}$, $R^{4A}$, $R^{4B}$, $R^{5A}$, $R^{5B}$, $R^{5C}$ are each independently for each occurrence absent, NH, O, S, $CH_2$, C(O)O, C(O)NH, $NHCH(R^a)C(O)$, $-C(O)-CH(R^a)-NH-$, CO, CH=N-O,

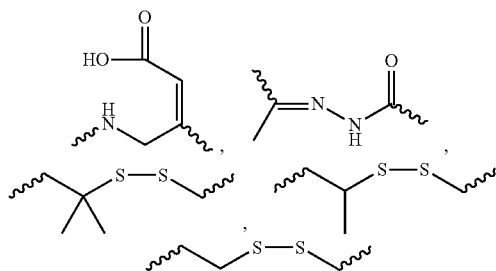

or heterocyclyl;

$L^{2A}$, $L^{2B}$, $L^{3A}$, $L^{3B}$, $L^{4A}$, $L^{4B}$, $L^{5A}$, $L^{5B}$ and $L^{5C}$ represent the ligand; i.e. each independently for each occurrence a monosaccharide (such as GalNAc), disaccharide, trisaccharide, tetrasaccharide, oligosaccharide, or polysaccharide; and $R^a$ is H or amino acid side chain. Trivalent conjugating GalNAc derivatives are particularly useful for use with RNAi agents for inhibiting the expression of a target gene, such as those of formula (XXXV):

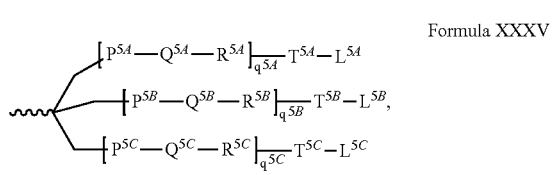

Formula XXXV wherein $L^{5A}$, $L^{5B}$ and $L^{5C}$ represent a monosaccharide, such as GalNAc derivative.

Examples of suitable bivalent and trivalent branched linker groups conjugating GalNAc derivatives include, but are not limited to, the structures recited above as formulas II, VII, XI, X, and XIII.

Representative U.S. patents that teach the preparation of RNA conjugates include, but are not limited to, U.S. Pat. Nos. 4,828,979; 4,948,882; 5,218,105; 5,525,465; 5,541,313; 5,545,730; 5,552,538; 5,578,717; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112, 963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941; 6,294,664; 6,320,017; 6,576,752; 6,783,931; 6,900,297; 7,037,646; 8,106,022, the entire contents of each of which are hereby incorporated herein by reference.

It is not necessary for all positions in a given compound to be uniformly modified, and in fact more than one of the aforementioned modifications can be incorporated in a single compound or even at a single nucleoside within an iRNA. The present invention also includes iRNA compounds that are chimeric compounds.

"Chimeric" iRNA compounds or "chimeras," in the context of this invention, are iRNA compounds, preferably dsRNAs, which contain two or more chemically distinct regions, each made up of at least one monomer unit, i.e., a nucleotide in the case of a dsRNA compound. These iRNAs typically contain at least one region wherein the RNA is modified so as to confer upon the iRNA increased resistance to nuclease degradation, increased cellular uptake, and/or increased binding affinity for the target nucleic acid. An additional region of the iRNA can serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of iRNA inhibition of gene expression. Consequently, comparable results can often be obtained with shorter iRNAs when chimeric dsRNAs are used, compared to phosphorothioate deoxy dsRNAs hybridizing to the same target region. Cleavage of the RNA target can be routinely detected by gel electrophoresis and, if necessary, associated nucleic acid hybridization techniques known in the art.

In certain instances, the RNA of an iRNA can be modified by a non-ligand group. A number of non-ligand molecules have been conjugated to iRNAs in order to enhance the activity, cellular distribution or cellular uptake of the iRNA, and procedures for performing such conjugations are available in the scientific literature. Such non-ligand moieties have included lipid moieties, such as cholesterol (Kubo, T. et al., *Biochem. Biophys. Res. Comm.,* 2007, 365(1):54-61; Letsinger et al., *Proc. Natl. Acad. Sci. USA,* 1989, 86:6553), cholic acid (Manoharan et al., *Bioorg. Med. Chem. Lett.,* 1994, 4:1053), a thioether, e.g., hexyl-S-tritylthiol (Manoharan et al., *Ann. N. Y. Acad. Sci.,* 1992, 660:306; Manoharan et al., *Bioorg. Med. Chem. Let.,* 1993, 3:2765), a thiocholesterol (Oberhauser et al., *Nucl. Acids Res.,* 1992, 20:533), an aliphatic chain, e.g., dodecandiol or undecyl residues (Saison-Behmoaras et al., *EMBO J.,* 1991, 10:111; Kabanov et al., *FEBS Lett.,* 1990, 259:327; Svinarchuk et al., *Biochimie,* 1993, 75:49), a phospholipid, e.g., di-hexadecyl-rac-glycerol or triethylammonium 1,2-di-O-hexadecyl-rac-glycero-3-H-phosphonate (Manoharan et al., *Tetrahedron Lett.,* 1995, 36:3651; Shea et al., *Nucl. Acids Res.,* 1990, 18:3777), a polyamine or a polyethylene glycol chain (Manoharan et al., *Nucleosides & Nucleotides,* 1995, 14:969), or adamantane acetic acid (Manoharan et al., *Tetrahedron Lett.,* 1995, 36:3651), a palmityl moiety (Mishra et al., *Biochim. Biophys. Acta,* 1995, 1264:229), or an octadecylamine or hexylamino-carbonyl-oxycholesterol moiety (Crooke et al., *J. Pharmacol. Exp. Ther.,* 1996, 277:923). Representative United States patents that teach the preparation of such RNA conjugates have been listed above. Typical conjugation protocols involve the synthesis of an RNAs bearing an aminolinker at one or more positions of the sequence. The amino group is then reacted with the molecule being conjugated using appropriate coupling or activating reagents. The conjugation reaction can be performed either with the RNA still bound to the solid support or following cleavage of the RNA, in solution phase. Purification of the RNA conjugate by HPLC typically affords the pure conjugate.

V. Delivery of an iRNA of the Invention

The delivery of an iRNA of the invention to a cell e.g., a cell within a subject, such as a human subject (e.g., a subject in need thereof, such as a subject having a disease, disorder or condition associated with PNPLA3 gene expression) can be achieved in a number of different ways. For example, delivery may be performed by contacting a cell with an iRNA of the invention either in vitro or in vivo. In vivo delivery may also be performed directly by administering a composition comprising an iRNA, e.g., a dsRNA, to a subject. Alternatively, in vivo delivery may be performed indirectly by administering one or more vectors that encode and direct the expression of the iRNA. These alternatives are discussed further below.

In general, any method of delivering a nucleic acid molecule (in vitro or in vivo) can be adapted for use with an iRNA of the invention (see e.g., Akhtar S. and Julian R L. (1992) *Trends Cell. Biol.* 2(5):139-144 and WO94/02595, which are incorporated herein by reference in their entireties). For in vivo delivery, factors to consider in order to deliver an iRNA molecule include, for example, biological stability of the delivered molecule, prevention of non-specific effects, and accumulation of the delivered molecule in the target tissue. The non-specific effects of an iRNA can be minimized by local administration, for example, by direct injection or implantation into a tissue or topically administering the preparation. Local administration to a treatment site maximizes local concentration of the agent, limits the exposure of the agent to systemic tissues that can otherwise be harmed by the agent or that can degrade the agent, and permits a lower total dose of the iRNA molecule to be administered. Several studies have shown successful knockdown of gene products when an iRNA is administered locally. For example, intraocular delivery of a VEGF dsRNA by intravitreal injection in cynomolgus monkeys (Tolentino, M J., et al (2004) *Retina* 24:132-138) and subretinal injections in mice (Reich, S J., et al (2003) *Mol. Vis.* 9:210-216) were both shown to prevent neovascularization in an experimental model of age-related macular degeneration. In addition, direct intratumoral injection of a dsRNA in mice reduces tumor volume (Pille, J., et al (2005) *Mol. Ther.* 11:267-274) and can prolong survival of tumor-bearing mice (Kim, W J., et al (2006) *Mol. Ther.* 14:343-350; Li, S., et al (2007) *Mol. Ther.* 15:515-523). RNA interference has also shown success with local delivery to the CNS by direct injection (Dorn, G., et al. (2004) *Nucleic Acids* 32:e49; Tan, P H., et al (2005) *Gene Ther.* 12:59-66; Makimura, H., et al (2002) *BMC Neurosci.* 3:18; Shishkina, G T., et al (2004) *Neuroscience* 129:521-528; Thakker, E R., et al (2004) *Proc. Natl. Acad. Sci. U.S.A.* 101:17270-17275; Akaneya, Y., et al (2005) *J. Neurophysiol.* 93:594-602) and to the lungs by intranasal administration (Howard, K A., et al (2006) *Mol. Ther.* 14:476-484; Zhang, X., et al (2004) *J. Biol. Chem.* 279:10677-10684; Bitko, V., et al (2005) *Nat. Med.* 11:50-55). For administering an iRNA systemically for the treatment of a disease, the RNA can be modified or alternatively delivered using a drug delivery system; both methods act to prevent the rapid degradation of the dsRNA by endo- and exo-nucleases in vivo. Modification of the RNA or the pharmaceutical carrier can also permit targeting of the iRNA composition to the target tissue and avoid undesirable off-target effects. iRNA molecules can be modified by chemical conjugation to lipophilic groups such as cholesterol to enhance cellular uptake and prevent degradation. For example, an iRNA directed against ApoB conjugated to a lipophilic cholesterol moiety was injected systemically into mice and resulted in knockdown of apoB mRNA in both the liver and jejunum (Soutschek, J., et al (2004) *Nature* 432:173-178). Conjugation of an iRNA to an aptamer has been shown to inhibit tumor growth and mediate tumor regression in a mouse model of prostate cancer (McNamara, J O., et al (2006) *Nat. Biotechnol.* 24:1005-1015). In an alternative embodiment, the iRNA can be delivered using drug delivery systems such as a nanoparticle, a dendrimer, a polymer, liposomes, or a cationic delivery system. Positively charged cationic delivery systems facilitate binding of an iRNA molecule (negatively charged) and also enhance interactions at the negatively charged cell membrane to permit efficient uptake of an iRNA by the cell. Cationic lipids, dendrimers, or polymers can either be bound to an iRNA, or induced to form a vesicle or micelle (see e.g., Kim S H., et al (2008) *Journal of Controlled Release* 129(2):107-116) that encases an iRNA. The formation of vesicles or micelles further prevents degradation of the iRNA when administered systemically. Methods for making and administering cationic-iRNA complexes are well within the abilities of one skilled in the art (see e.g., Sorensen, D R., et al (2003) *J. Mol. Biol* 327:761-766; Verma, U N., et al (2003) *Clin. Cancer Res.* 9:1291-1300; Arnold, A S et al (2007) *J. Hypertens.* 25:197-205, which are incorporated herein by reference in their entirety). Some non-limiting examples of drug delivery systems useful for systemic delivery of iRNAs include DOTAP (Sorensen, D R., et al (2003), supra; Verma, U N., et al (2003), supra), Oligofectamine, "solid nucleic acid lipid particles" (Zimmermann, T S., et al (2006) *Nature* 441:111-114), cardiolipin (Chien, P Y., et al (2005) *Cancer Gene Ther.* 12:321-328; Pal, A., et al (2005) *Int J. Oncol.* 26:1087-1091), polyethyleneimine (Bonnet M E., et al (2008) *Pharm. Res.* August 16 Epub ahead of print; Aigner, A. (2006) *J. Biomed. Biotechnol.* 71659), Arg-Gly-Asp (RGD) peptides (Liu, S. (2006) *Mol. Pharm.* 3:472-487), and polyamidoamines (Tomalia, D A., et al (2007) *Biochem. Soc. Trans.* 35:61-67; Yoo, H., et al (1999) *Pharm. Res.* 16:1799-1804). In some embodiments, an iRNA forms a complex with cyclodextrin for systemic administration. Methods for administration and pharmaceutical compositions of iRNAs and cyclodextrins can be found in U.S. Pat. No. 7,427,605, which is herein incorporated by reference in its entirety.

A. Vector Encoded iRNAs of the Invention iRNA targeting the PNPLA3 gene can be expressed from transcription units inserted into DNA or RNA vectors (see, e.g., Couture, A, et al., *TIG.* (1996), 12:5-10; Skillern, A., et al., International PCT Publication No. WO 00/22113, Conrad, International PCT Publication No. WO 00/22114, and Conrad, U.S. Pat. No. 6,054,299). Expression can be transient (on the order of hours to weeks) or sustained (weeks to months or longer), depending upon the specific construct used and the target tissue or cell type. These transgenes can be introduced as a linear construct, a circular plasmid, or a viral vector, which can be an integrating or non-integrating vector. The transgene can also be constructed to permit it to be inherited as an extrachromosomal plasmid (Gassmann, et al., *Proc. Natl. Acad. Sci. USA* (1995) 92:1292).

The individual strand or strands of an iRNA can be transcribed from a promoter on an expression vector. Where two separate strands are to be expressed to generate, for example, a dsRNA, two separate expression vectors can be co-introduced (e.g., by transfection or infection) into a target cell. Alternatively each individual strand of a dsRNA can be transcribed by promoters both of which are located on the same expression plasmid. In one embodiment, a dsRNA is expressed as inverted repeat polynucleotides joined by a linker polynucleotide sequence such that the dsRNA has a stem and loop structure.

iRNA expression vectors are generally DNA plasmids or viral vectors. Expression vectors compatible with eukaryotic cells, preferably those compatible with vertebrate cells, can be used to produce recombinant constructs for the expression of an iRNA as described herein. Eukaryotic cell expression vectors are well known in the art and are available from a number of commercial sources. Typically, such vectors are provided containing convenient restriction sites for insertion of the desired nucleic acid segment. Delivery of iRNA expressing vectors can be systemic, such as by intravenous or intramuscular administration, by administration to target cells ex-planted from the patient followed by reintroduction into the patient, or by any other means that allows for introduction into a desired target cell.

iRNA expression plasmids can be transfected into target cells as a complex with cationic lipid carriers (e.g., Oligofectamine) or non-cationic lipid-based carriers (e.g., Transit-TKO™). Multiple lipid transfections for iRNA-mediated knockdowns targeting different regions of a target RNA over a period of a week or more are also contemplated by the invention. Successful introduction of vectors into host cells can be monitored using various known methods. For example, transient transfection can be signaled with a reporter, such as a fluorescent marker, such as Green Fluorescent Protein (GFP). Stable transfection of cells ex vivo can be ensured using markers that provide the transfected cell with resistance to specific environmental factors (e.g., antibiotics and drugs), such as hygromycin B resistance.

Viral vector systems which can be utilized with the methods and compositions described herein include, but are not limited to, (a) adenovirus vectors; (b) retrovirus vectors, including but not limited to lentiviral vectors, moloney murine leukemia virus, etc.; (c) adeno-associated virus vectors; (d) herpes simplex virus vectors; (e) SV 40 vectors; (f) polyoma virus vectors; (g) papilloma virus vectors; (h) picornavirus vectors; (i) pox virus vectors such as an orthopox, e.g., vaccinia virus vectors or avipox, e.g. canary pox or fowl pox; and (j) a helper-dependent or gutless adenovirus. Replication-defective viruses can also be advantageous. Different vectors will or will not become incorporated into the cells' genome. The constructs can include viral sequences for transfection, if desired. Alternatively, the construct can be incorporated into vectors capable of episomal replication, e.g. EPV and EBV vectors. Constructs for the recombinant expression of an iRNA will generally require regulatory elements, e.g., promoters, enhancers, etc., to ensure the expression of the iRNA in target cells. Other aspects to consider for vectors and constructs are further described below.

Vectors useful for the delivery of an iRNA will include regulatory elements (promoter, enhancer, etc.) sufficient for expression of the iRNA in the desired target cell or tissue. The regulatory elements can be chosen to provide either constitutive or regulated/inducible expression.

Expression of the iRNA can be precisely regulated, for example, by using an inducible regulatory sequence that is sensitive to certain physiological regulators, e.g., circulating glucose levels, or hormones (Docherty et al., 1994, *FASEB J.* 8:20-24). Such inducible expression systems, suitable for the control of dsRNA expression in cells or in mammals include, for example, regulation by ecdysone, by estrogen, progesterone, tetracycline, chemical inducers of dimerization, and isopropyl-beta-D1-thiogalactopyranoside (IPTG). A person skilled in the art would be able to choose the appropriate regulatory/promoter sequence based on the intended use of the iRNA transgene.

Viral vectors that contain nucleic acid sequences encoding an iRNA can be used. For example, a retroviral vector can be used (see Miller et al., *Meth. Enzymol.* 217:581-599 (1993)). These retroviral vectors contain the components necessary for the correct packaging of the viral genome and integration into the host cell DNA. The nucleic acid sequences encoding an iRNA are cloned into one or more vectors, which facilitate delivery of the nucleic acid into a patient. More detail about retroviral vectors can be found, for example, in Boesen et al., *Biotherapy* 6:291-302 (1994), which describes the use of a retroviral vector to deliver the mdr1 gene to hematopoietic stem cells in order to make the stem cells more resistant to chemotherapy. Other references illustrating the use of retroviral vectors in gene therapy are: Clowes et al., *J. Clin. Invest.* 93:644-651 (1994); Kiem et al., *Blood* 83:1467-1473 (1994); Salmons and Gunzberg, *Human Gene Therapy* 4:129-141 (1993); and Grossman and Wilson, *Curr. Opin. in Genetics and Devel.* 3:110-114 (1993). Lentiviral vectors contemplated for use include, for example, the HIV based vectors described in U.S. Pat. Nos. 6,143,520; 5,665,557; and 5,981,276, which are herein incorporated by reference.

Adenoviruses are also contemplated for use in delivery of iRNAs of the invention. Adenoviruses are especially attractive vehicles, e.g., for delivering genes to respiratory epithelia. Adenoviruses naturally infect respiratory epithelia where they cause a mild disease. Other targets for adenovirus-based delivery systems are liver, the central nervous system, endothelial cells, and muscle. Adenoviruses have the advantage of being capable of infecting non-dividing cells. Kozarsky and Wilson, *Current Opinion in Genetics and Development* 3:499-503 (1993) present a review of adenovirus-based gene therapy. Bout et al., *Human Gene Therapy* 5:3-10 (1994) demonstrated the use of adenovirus vectors to transfer genes to the respiratory epithelia of rhesus monkeys. Other instances of the use of adenoviruses in gene therapy can be found in Rosenfeld et al., *Science* 252:431-434 (1991); Rosenfeld et al., *Cell* 68:143-155 (1992); Mastrangeli et al., *J. Clin. Invest.* 91:225-234 (1993); PCT Publication WO94/12649; and Wang, et al., *Gene Therapy* 2:775-783 (1995). A suitable AV vector for expressing an iRNA featured in the invention, a method for constructing the recombinant AV vector, and a method for delivering the vector into target cells, are described in Xia H et al. (2002), *Nat. Biotech.* 20: 1006-1010.

Adeno-associated virus (AAV) vectors may also be used to delivery an iRNA of the invention (Walsh et al., Proc. Soc. Exp. Biol. Med. 204:289-300 (1993); U.S. Pat. No. 5,436, 146). In one embodiment, the iRNA can be expressed as two separate, complementary single-stranded RNA molecules from a recombinant AAV vector having, for example, either the U6 or H1 RNA promoters, or the cytomegalovirus (CMV) promoter. Suitable AAV vectors for expressing the dsRNA featured in the invention, methods for constructing the recombinant AV vector, and methods for delivering the vectors into target cells are described in Samulski R et al. (1987), *J. Virol.* 61: 3096-3101; Fisher K J et al. (1996), *J. Virol,* 70: 520-532; Samulski R et al. (1989), *J. Virol.* 63: 3822-3826; U.S. Pat. Nos. 5,252,479; 5,139,941; International Patent Application No. WO 94/13788; and International Patent Application No. WO 93/24641, the entire disclosures of which are herein incorporated by reference.

Another viral vector suitable for delivery of an iRNA of the invention is a pox virus such as a vaccinia virus, for example an attenuated vaccinia such as Modified Virus Ankara (MVA) or NYVAC, an avipox such as fowl pox or canary pox.

The tropism of viral vectors can be modified by pseudotyping the vectors with envelope proteins or other surface antigens from other viruses, or by substituting different viral capsid proteins, as appropriate. For example, lentiviral vectors can be pseudotyped with surface proteins from vesicular stomatitis virus (VSV), rabies, Ebola, Mokola, and the like. AAV vectors can be made to target different cells by engineering the vectors to express different capsid protein serotypes; see, e.g., Rabinowitz J E et al. (2002), *J Virol* 76:791-801, the entire disclosure of which is herein incorporated by reference.

The pharmaceutical preparation of a vector can include the vector in an acceptable diluent, or can include a slow release matrix in which the gene delivery vehicle is imbedded. Alternatively, where the complete gene delivery vector can be produced intact from recombinant cells, e.g., retroviral vectors, the pharmaceutical preparation can include one or more cells which produce the gene delivery system.

VI. Pharmaceutical Compositions of the Invention

The present invention also includes pharmaceutical compositions and formulations which include the iRNAs of the invention. In one embodiment, provided herein are pharmaceutical compositions containing an iRNA, as described herein, and a pharmaceutically acceptable carrier. The pharmaceutical compositions containing the iRNA are useful for treating a disease or disorder associated with the expression or activity of an PNPLA3 gene.

Such pharmaceutical compositions are formulated based on the mode of delivery. One example is compositions that are formulated for systemic administration via parenteral delivery, e.g., by subcutaneous (SC), intramuscular, (IM), or intravenous (IV) delivery. Another example is compositions that are formulated for direct delivery into the brain parenchyma, e.g., by infusion into the brain, such as by continuous pump infusion. The pharmaceutical compositions of the invention may be administered in dosages sufficient to inhibit expression of an PNPLA3 gene.

The pharmaceutical compositions of the invention may be administered in dosages sufficient to inhibit expression of a PNPLA3 gene. In general, a suitable dose of an iRNA of the invention will be in the range of about 0.001 to about 200.0 milligrams per kilogram body weight of the recipient per day, generally in the range of about 1 to 50 mg per kilogram body weight per day. For example, the dsRNA can be administered at about 0.01 mg/kg, about 0.05 mg/kg, about 0.5 mg/kg, about 1 mg/kg, about 1.5 mg/kg, about 2 mg/kg, about 3 mg/kg, about 10 mg/kg, about 20 mg/kg, about 30 mg/kg, about 40 mg/kg, or about 50 mg/kg per single dose. A repeat-dose regimine may include administration of a therapeutic amount of iRNA on a regular basis, such as every other day or once a year. In certain embodiments, the iRNA is administered about once per month to about once per quarter (i.e., about once every three months). After an initial treatment regimen, the treatments can be administered on a less frequent basis.

The skilled artisan will appreciate that certain factors can influence the dosage and timing required to effectively treat a subject, including but not limited to the severity of the disease or disorder, previous treatments, the general health and/or age of the subject, and other diseases present. Moreover, treatment of a subject with a therapeutically effective amount of a composition can include a single treatment or a series of treatments. Estimates of effective dosages and in vivo half-lives for the individual iRNAs encompassed by the invention can be made using conventional methodologies or on the basis of in vivo testing using an appropriate animal model, as known in the art.

Advances in mouse genetics have generated a number of mouse models for the study of various human diseases, such as a disorder that would benefit from reduction in the expression of PNPLA3. Such models can be used for in vivo testing of an agent, as well as for determining a therapeutically effective dose. Suitable dietary and genetic mouse models are reviewed in Kanuri and Bergheim (*Int. J. Mol. Sci.* (2013) 14:11963-11980).

The pharmaceutical compositions of the present invention can be administered in a number of ways depending upon whether local or systemic treatment is desired and upon the area to be treated. Administration can be topical (e.g., by a transdermal patch), pulmonary, e.g., by inhalation or insufflation of powders or aerosols, including by nebulizer; intratracheal, intranasal, epidermal and transdermal, oral or parenteral. Parenteral administration includes intravenous, intraarterial, subcutaneous, intraperitoneal or intramuscular injection or infusion; subdermal, e.g., via an implanted device; or intracranial, e.g., by intraparenchymal, intrathecal or intraventricular, administration.

The iRNA can be delivered in a manner to target a particular tissue such as the liver (e.g., the hepatocytes of the liver).

Pharmaceutical compositions and formulations for topical administration can include transdermal patches, ointments, lotions, creams, gels, drops, suppositories, sprays, liquids and powders. Conventional pharmaceutical carriers, aqueous, powder or oily bases, thickeners and the like can be necessary or desirable. Coated condoms, gloves and the like can also be useful. Suitable topical formulations include those in which the iRNAs featured in the invention are in admixture with a topical delivery agent such as lipids, liposomes, fatty acids, fatty acid esters, steroids, chelating agents and surfactants. Suitable lipids and liposomes include neutral (e.g., dioleoylphosphatidyl DOPE ethanolamine, dimyristoylphosphatidyl choline DMPC, distearolyphosphatidyl choline) negative (e.g., dimyristoylphosphatidyl glycerol DMPG) and cationic (e.g., dioleoyltetramethylaminopropyl DOTAP and dioleoylphosphatidyl ethanolamine DOTMA). iRNAs featured in the invention can be encapsulated within liposomes or can form complexes thereto, in particular to cationic liposomes. Alternatively, iRNAs can be complexed to lipids, in particular to cationic lipids. Suitable fatty acids and esters include but are not limited to arachidonic acid, oleic acid, eicosanoic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a $C_{1-20}$ alkyl ester (e.g., isopropylmyristate IPM), monoglyceride, diglyceride or pharmaceutically acceptable salt thereof). Topical formulations are described in detail in U.S. Pat. No. 6,747,014, which is incorporated herein by reference.

A. iRNA Formulations Comprising Membranous Molecular Assemblies

An iRNA for use in the compositions and methods of the invention can be formulated for delivery in a membranous molecular assembly, e.g., a liposome or a micelle. As used herein, the term "liposome" refers to a vesicle composed of amphiphilic lipids arranged in at least one bilayer, e.g., one bilayer or a plurality of bilayers. Liposomes include unilamellar and multilamellar vesicles that have a membrane formed from a lipophilic material and an aqueous interior. The aqueous portion contains the iRNA composition. The lipophilic material isolates the aqueous interior from an aqueous exterior, which typically does not include the iRNA composition, although in some examples, it may. Liposomes are useful for the transfer and delivery of active ingredients to the site of action. Because the liposomal membrane is structurally similar to biological membranes, when liposomes are applied to a tissue, the liposomal bilayer fuses with bilayer of the cellular membranes. As the merging of the liposome and cell progresses, the internal aqueous contents that include the iRNA are delivered into the cell where the iRNA can specifically bind to a target RNA and can mediate iRNA. In some cases the liposomes are also specifically targeted, e.g., to direct the iRNA to particular cell types.

A liposome containing an iRNA agent can be prepared by a variety of methods. In one example, the lipid component of a liposome is dissolved in a detergent so that micelles are formed with the lipid component. For example, the lipid component can be an amphipathic cationic lipid or lipid conjugate. The detergent can have a high critical micelle concentration and may be nonionic. Exemplary detergents include cholate, CHAPS, octylglucoside, deoxycholate, and lauroyl sarcosine. The iRNA agent preparation is then added to the micelles that include the lipid component. The cationic groups on the lipid interact with the iRNA agent and condense around the iRNA agent to form a liposome. After condensation, the detergent is removed, e.g., by dialysis, to yield a liposomal preparation of iRNA agent.

If necessary a carrier compound that assists in condensation can be added during the condensation reaction, e.g., by controlled addition. For example, the carrier compound can be a polymer other than a nucleic acid (e.g., spermine or spermidine). pH can also adjusted to favor condensation.

Methods for producing stable polynucleotide delivery vehicles, which incorporate a polynucleotide/cationic lipid complex as structural components of the delivery vehicle, are further described in, e.g., WO 96/37194, the entire contents of which are incorporated herein by reference. Liposome formation can also include one or more aspects of exemplary methods described in Felgner, P. L. et al., *Proc. Natl. Acad. Sci., USA* 8:7413-7417, 1987; U.S. Pat. Nos. 4,897,355; 5,171,678; Bangham, et al. *M. Mol. Biol.* 23:238, 1965; Olson, et al. *Biochim. Biophys. Acta* 557:9, 1979; Szoka, et al. *Proc. Natl. Acad. Sci.* 75: 4194, 1978; Mayhew, et al. *Biochim. Biophys. Acta* 775:169, 1984; Kim, et al. *Biochim. Biophys. Acta* 728:339, 1983; and Fukunaga, et al. *Endocrinol.* 115:757, 1984. Commonly used techniques for preparing lipid aggregates of appropriate size for use as delivery vehicles include sonication and freeze-thaw plus extrusion (see, e.g., Mayer, et al. *Biochim. Biophys. Acta* 858:161, 1986). Microfluidization can be used when consistently small (50 to 200 nm) and relatively uniform aggregates are desired (Mayhew, et al. *Biochim. Biophys. Acta*

775:169, 1984). These methods are readily adapted to packaging iRNA agent preparations into liposomes.

Liposomes fall into two broad classes. Cationic liposomes are positively charged liposomes which interact with the negatively charged nucleic acid molecules to form a stable complex. The positively charged nucleic acid/liposome complex binds to the negatively charged cell surface and is internalized in an endosome. Due to the acidic pH within the endosome, the liposomes are ruptured, releasing their contents into the cell cytoplasm (Wang et al., *Biochem. Biophys. Res. Commun.*, 1987, 147, 980-985).

Liposomes which are pH-sensitive or negatively-charged, entrap nucleic acids rather than complex with it. Since both the nucleic acid and the lipid are similarly charged, repulsion rather than complex formation occurs. Nevertheless, some nucleic acid is entrapped within the aqueous interior of these liposomes. pH-sensitive liposomes have been used to deliver nucleic acids encoding the thymidine kinase gene to cell monolayers in culture. Expression of the exogenous gene was detected in the target cells (Zhou et al., *Journal of Controlled Release*, 1992, 19, 269-274).

One major type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid and/or phosphatidylcholine and/or cholesterol.

Examples of other methods to introduce liposomes into cells in vitro and in vivo include U.S. Pat. Nos. 5,283,185; 5,171,678; WO 94/00569; WO 93/24640; WO 91/16024; Felgner, *J. Biol. Chem.* 269:2550, 1994; Nabel, *Proc. Natl. Acad. Sci.* 90:11307, 1993; Nabel, *Human Gene Ther.* 3:649, 1992; Gershon, *Biochem.* 32:7143, 1993; and Strauss *EMBO J.* 11:417, 1992.

Non-ionic liposomal systems have also been examined to determine their utility in the delivery of drugs to the skin, in particular systems comprising non-ionic surfactant and cholesterol. Non-ionic liposomal formulations comprising Novasome™ I (glyceryl dilaurate/cholesterol/polyoxyethylene-10-stearyl ether) and Novasome™ II (glyceryl distearate/cholesterol/polyoxyethylene-10-stearyl ether) were used to deliver cyclosporin-A into the dermis of mouse skin. Results indicated that such non-ionic liposomal systems were effective in facilitating the deposition of cyclosporine A into different layers of the skin (Hu et al. *S.T.P.Pharma. Sci.*, 1994, 4(6) 466).

Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids. Examples of sterically stabilized liposomes are those in which part of the vesicle-forming lipid portion of the liposome (A) comprises one or more glycolipids, such as monosialoganglioside $G_{M1}$, or (B) is derivatized with one or more hydrophilic polymers, such as a polyethylene glycol (PEG) moiety. While not wishing to be bound by any particular theory, it is thought in the art that, at least for sterically stabilized liposomes containing gangliosides, sphingomyelin, or PEG-derivatized lipids, the enhanced circulation half-life of these sterically stabilized liposomes derives from a reduced uptake into cells of the reticuloendothelial system (RES) (Allen et al., *FEBS Letters*, 1987, 223, 42; Wu et al., *Cancer Research*, 1993, 53, 3765).

Various liposomes comprising one or more glycolipids are known in the art. Papahadjopoulos et al. (*Ann. N.Y. Acad. Sci.*, 1987, 507, 64) reported the ability of monosialoganglioside $G_{M1}$, galactocerebroside sulfate and phosphatidylinositol to improve blood half-lives of liposomes. These findings were expounded upon by Gabizon et al. (*Proc. Natl. Acad. Sci. U.S.A.*, 1988, 85, 6949). U.S. Pat. No. 4,837,028 and WO 88/04924, both to Allen et al., disclose liposomes comprising (1) sphingomyelin and (2) the ganglioside $G_{M1}$ or a galactocerebroside sulfate ester. U.S. Pat. No. 5,543,152 (Webb et al.) discloses liposomes comprising sphingomyelin. Liposomes comprising 1,2-sn-dimyristoylphosphatidylcholine are disclosed in WO 97/13499 (Lim et al).

In one embodiment, cationic liposomes are used. Cationic liposomes possess the advantage of being able to fuse to the cell membrane. Non-cationic liposomes, although not able to fuse as efficiently with the plasma membrane, are taken up by macrophages in vivo and can be used to deliver iRNA agents to macrophages.

Further advantages of liposomes include: liposomes obtained from natural phospholipids are biocompatible and biodegradable; liposomes can incorporate a wide range of water and lipid soluble drugs; liposomes can protect encapsulated iRNA agents in their internal compartments from metabolism and degradation (Rosoff, in "Pharmaceutical Dosage Forms," Lieberman, Rieger and Banker (Eds.), 1988, volume 1, p. 245). Important considerations in the preparation of liposome formulations are the lipid surface charge, vesicle size and the aqueous volume of the liposomes.

A positively charged synthetic cationic lipid, N-[1-(2,3-dioleyloxy)propyl]-N,N,N-trimethylammonium chloride (DOTMA) can be used to form small liposomes that interact spontaneously with nucleic acid to form lipid-nucleic acid complexes which are capable of fusing with the negatively charged lipids of the cell membranes of tissue culture cells, resulting in delivery of iRNA agent (see, e.g., Felgner, P. L. et al., Proc. Natl. Acad. Sci., USA 8:7413-7417, 1987 and U.S. Pat. No. 4,897,355 for a description of DOTMA and its use with DNA).

A DOTMA analogue, 1,2-bis(oleoyloxy)-3-(trimethylammonia)propane (DOTAP) can be used in combination with a phospholipid to form DNA-complexing vesicles. Lipofectin™ Bethesda Research Laboratories, Gaithersburg, Md.) is an effective agent for the delivery of highly anionic nucleic acids into living tissue culture cells that comprise positively charged DOTMA liposomes which interact spontaneously with negatively charged polynucleotides to form complexes. When enough positively charged liposomes are used, the net charge on the resulting complexes is also positive. Positively charged complexes prepared in this way spontaneously attach to negatively charged cell surfaces, fuse with the plasma membrane, and efficiently deliver functional nucleic acids into, for example, tissue culture cells. Another commercially available cationic lipid, 1,2-bis(oleoyloxy)-3,3-(trimethylammonia)propane ("DOTAP") (Boehringer Mannheim, Indianapolis, Ind.) differs from DOTMA in that the oleoyl moieties are linked by ester, rather than ether linkages.

Other reported cationic lipid compounds include those that have been conjugated to a variety of moieties including, for example, carboxyspermine which has been conjugated to one of two types of lipids and includes compounds such as 5-carboxyspermylglycine dioctaoleoylamide ("DOGS")

(Transfectam™, Promega, Madison, Wis.) and dipalmitoyl-phosphatidylethanolamine 5-carboxyspermyl-amide ("DPPES") (see, e.g., U.S. Pat. No. 5,171,678).

Another cationic lipid conjugate includes derivatization of the lipid with cholesterol ("DC-Chol") which has been formulated into liposomes in combination with DOPE (See, Gao, X. and Huang, L., Biochim. Biophys. Res. Commun. 179:280, 1991). Lipopolylysine, made by conjugating polylysine to DOPE, has been reported to be effective for transfection in the presence of serum (Zhou, X. et al., Biochim. Biophys. Acta 1065:8, 1991). For certain cell lines, these liposomes containing conjugated cationic lipids, are said to exhibit lower toxicity and provide more efficient transfection than the DOTMA-containing compositions. Other commercially available cationic lipid products include DMRIE and DMRIE-HP (Vical, La Jolla, Calif.) and Lipofectamine (DOSPA) (Life Technology, Inc., Gaithersburg, Md.). Other cationic lipids suitable for the delivery of oligonucleotides are described in WO 98/39359 and WO 96/37194.

Liposomal formulations are particularly suited for topical administration, liposomes present several advantages over other formulations. Such advantages include reduced side effects related to high systemic absorption of the administered drug, increased accumulation of the administered drug at the desired target, and the ability to administer iRNA agent into the skin. In some implementations, liposomes are used for delivering iRNA agent to epidermal cells and also to enhance the penetration of iRNA agent into dermal tissues, e.g., into skin. For example, the liposomes can be applied topically. Topical delivery of drugs formulated as liposomes to the skin has been documented (see, e.g., Weiner et al., Journal of Drug Targeting, 1992, vol. 2, 405-410 and du Plessis et al., Antiviral Research, 18, 1992, 259-265; Mannino, R. J. and Fould-Fogerite, S., Biotechniques 6:682-690, 1988; Itani, T. et al. Gene 56:267-276. 1987; Nicolau, C. et al. Meth. Enz. 149:157-176, 1987; Straubinger, R. M. and Papahadjopoulos, D. Meth. Enz. 101:512-527, 1983; Wang, C. Y. and Huang, L., Proc. Natl. Acad. Sci. USA 84:7851-7855, 1987).

Non-ionic liposomal systems have also been examined to determine their utility in the delivery of drugs to the skin, in particular systems comprising non-ionic surfactant and cholesterol. Non-ionic liposomal formulations comprising Novasome I (glyceryl dilaurate/cholesterol/polyoxyethylene-10-stearyl ether) and Novasome II (glyceryl distearate/cholesterol/polyoxyethylene-10-stearyl ether) were used to deliver a drug into the dermis of mouse skin. Such formulations with iRNA agent are useful for treating a dermatological disorder.

Liposomes that include iRNA can be made highly deformable. Such deformability can enable the liposomes to penetrate through pore that are smaller than the average radius of the liposome. For example, transfersomes are a type of deformable liposomes. Transferosomes can be made by adding surface edge activators, usually surfactants, to a standard liposomal composition. Transfersomes that include iRNA agent can be delivered, for example, subcutaneously by infection in order to deliver iRNA agent to keratinocytes in the skin. In order to cross intact mammalian skin, lipid vesicles must pass through a series of fine pores, each with a diameter less than 50 nm, under the influence of a suitable transdermal gradient. In addition, due to the lipid properties, these transferosomes can be self-optimizing (adaptive to the shape of pores, e.g., in the skin), self-repairing, and can frequently reach their targets without fragmenting, and often self-loading.

Other formulations amenable to the present invention are described in U.S. provisional application Ser. No. 61/018,616, filed Jan. 2, 2008; 61/018,611, filed Jan. 2, 2008; 61/039,748, filed Mar. 26, 2008; 61/047,087, filed Apr. 22, 2008 and 61/051,528, filed May 8, 2008. PCT application no PCT/US2007/080331, filed Oct. 3, 2007 also describes formulations that are amenable to the present invention.

Transfersomes are yet another type of liposomes, and are highly deformable lipid aggregates which are attractive candidates for drug delivery vehicles. Transfersomes can be described as lipid droplets which are so highly deformable that they are easily able to penetrate through pores which are smaller than the droplet. Transfersomes are adaptable to the environment in which they are used, e.g., they are self-optimizing (adaptive to the shape of pores in the skin), self-repairing, frequently reach their targets without fragmenting, and often self-loading. To make transfersomes it is possible to add surface edge-activators, usually surfactants, to a standard liposomal composition. Transfersomes have been used to deliver serum albumin to the skin. The transfersome-mediated delivery of serum albumin has been shown to be as effective as subcutaneous injection of a solution containing serum albumin.

Surfactants find wide application in formulations such as emulsions (including microemulsions) and liposomes. The most common way of classifying and ranking the properties of the many different types of surfactants, both natural and synthetic, is by the use of the hydrophile/lipophile balance (HLB). The nature of the hydrophilic group (also known as the "head") provides the most useful means for categorizing the different surfactants used in formulations (Rieger, in "Pharmaceutical Dosage Forms", Marcel Dekker, Inc., New York, N.Y., 1988, p. 285).

If the surfactant molecule is not ionized, it is classified as a nonionic surfactant. Nonionic surfactants find wide application in pharmaceutical and cosmetic products and are usable over a wide range of pH values. In general their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines and phosphatides.

The use of surfactants in drug products, formulations and in emulsions has been reviewed (Rieger, in "Pharmaceutical Dosage Forms", Marcel Dekker, Inc., New York, N.Y., 1988, p. 285).

The iRNA for use in the methods of the invention can also be provided as micellar formulations. "Micelles" are defined herein as a particular type of molecular assembly in which amphipathic molecules are arranged in a spherical structure such that all the hydrophobic portions of the molecules are directed inward, leaving the hydrophilic portions in contact with the surrounding aqueous phase. The converse arrangement exists if the environment is hydrophobic.

A mixed micellar formulation suitable for delivery through transdermal membranes may be prepared by mixing an aqueous solution of the siRNA composition, an alkali metal $C_8$ to $C_{22}$ alkyl sulphate, and a micelle forming compounds. Exemplary micelle forming compounds include lecithin, hyaluronic acid, pharmaceutically acceptable salts of hyaluronic acid, glycolic acid, lactic acid, chamomile extract, cucumber extract, oleic acid, linoleic acid, linolenic acid, monoolein, monooleates, monolaurates, borage oil, evening of primrose oil, menthol, trihydroxy oxo cholanyl glycine and pharmaceutically acceptable salts thereof, glycerin, polyglycerin, lysine, polylysine, triolein, polyoxyethylene ethers and analogues thereof, polidocanol alkyl ethers and analogues thereof, chenodeoxycholate, deoxycholate, and mixtures thereof. The micelle forming compounds may be added at the same time or after addition of the alkali metal alkyl sulphate. Mixed micelles will form with substantially any kind of mixing of the ingredients but vigorous mixing in order to provide smaller size micelles.

In one method a first micellar composition is prepared which contains the siRNA composition and at least the alkali metal alkyl sulphate. The first micellar composition is then mixed with at least three micelle forming compounds to form a mixed micellar composition. In another method, the micellar composition is prepared by mixing the siRNA composition, the alkali metal alkyl sulphate and at least one of the micelle forming compounds, followed by addition of the remaining micelle forming compounds, with vigorous mixing.

Phenol and/or m-cresol may be added to the mixed micellar composition to stabilize the formulation and protect against bacterial growth. Alternatively, phenol and/or m-cresol may be added with the micelle forming ingredients. An isotonic agent such as glycerin may also be added after formation of the mixed micellar composition.

For delivery of the micellar formulation as a spray, the formulation can be put into an aerosol dispenser and the dispenser is charged with a propellant. The propellant, which is under pressure, is in liquid form in the dispenser. The ratios of the ingredients are adjusted so that the aqueous and propellant phases become one, i.e., there is one phase. If there are two phases, it is necessary to shake the dispenser prior to dispensing a portion of the contents, e.g., through a metered valve. The dispensed dose of pharmaceutical agent is propelled from the metered valve in a fine spray.

Propellants may include hydrogen-containing chlorofluorocarbons, hydrogen-containing fluorocarbons, dimethyl ether and diethyl ether. In certain embodiments, HFA 134a (1,1,1,2 tetrafluoroethane) may be used.

The specific concentrations of the essential ingredients can be determined by relatively straightforward experimentation. For absorption through the oral cavities, it is often desirable to increase, e.g., at least double or triple, the dosage for through injection or administration through the gastrointestinal tract.

B. Lipid Particles iRNAs, e.g., dsRNAs, of in the invention may be fully encapsulated in a lipid formulation, e.g., a LNP, or other nucleic acid-lipid particle. The term "lipid nanoparticle" or "LNP" is a vesicle comprising a lipid layer encapsulating a pharmaceutically active molecule, such as a nucleic acid molecule, e.g., an iRNA or a plasmid from which an iRNA is transcribed. LNPs are described in, for example, U.S. Pat. Nos. 6,858,225, 6,815,432, 8,158,601, and 8,058,069, the entire contents of which are hereby incorporated herein by reference.

LNPs typically contain a cationic lipid, a non-cationic lipid, and a lipid that prevents aggregation of the particle (e.g., a PEG-lipid conjugate). LNPs are extremely useful for systemic applications, as they exhibit extended circulation lifetimes following intravenous (i.v.) injection and accumulate at distal sites (e.g., sites physically separated from the administration site). LNPs include "pSPLP," which include an encapsulated condensing agent-nucleic acid complex as set forth in PCT Publication No. WO 00/03683. The particles of the present invention typically have a mean diameter of about 50 nm to about 150 nm, more typically about 60 nm to about 130 nm, more typically about 70 nm to about 110 nm, most typically about 70 nm to about 90 nm, and are substantially nontoxic. In addition, the nucleic acids when present in the nucleic acid-lipid particles of the present invention are resistant in aqueous solution to degradation with a nuclease. Nucleic acid-lipid particles and their method of preparation are disclosed in, e.g., U.S. Pat. Nos. 5,976,567; 5,981,501; 6,534,484; 6,586,410; 6,815,432; U.S. Publication No. 2010/0324120 and PCT Publication No. WO 96/40964.

In one embodiment, the lipid to drug ratio (mass/mass ratio) (e.g., lipid to dsRNA ratio) will be in the range of from about 1:1 to about 50:1, from about 1:1 to about 25:1, from about 3:1 to about 15:1, from about 4:1 to about 10:1, from about 5:1 to about 9:1, or about 6:1 to about 9:1. Ranges intermediate to the above recited ranges are also contemplated to be part of the invention.

The cationic lipid can be, for example, N,N-dioleyl-N,N-dimethylammonium chloride (DODAC), N,N-distearyl-N,N-dimethylammonium bromide (DDAB), N—(I-(2,3-dioleyloxy)propyl)-N,N,N-trimethylammonium chloride (DOTAP), N—(I-(2,3-dioleyloxy)propyl)-N,N,N-trimethylammonium chloride (DOTMA), N,N-dimethyl-2,3-dioleyloxy)propylamine (DODMA), 1,2-DiLinoleyloxy-N,N-dimethylaminopropane (DLinDMA), 1,2-Dilinolenyloxy-N,N-dimethylaminopropane (DLenDMA), 1,2-Dilinoleylcarbamoyloxy-3-dimethylaminopropane (DLin-C-DAP), 1,2-Dilinoleyoxy-3-(dimethylamino)acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA.Cl), 1,2-Dilinoleoyl-3-trimethylaminopropane chloride salt (DLin-TAP.Cl), 1,2-Dilinoleyloxy-3-(N-methylpiperazino)propane (DLin-MPZ), or 3-(N,N-Dilinoleylamino)-1,2-propanediol (DLinAP), 3-(N,N-Dioleylamino)-1,2-propanedio (DOAP), 1,2-Dilinoleyloxo-3-(2-N,N-dimethylamino)ethoxypropane (DLin-EG-DMA), 1,2-Dilinolenyloxy-N,N-dimethylaminopropane (DLinDMA), 2,2-Dilinoleyl-4-dimethylaminomethyl-[1,3]-dioxolane (DLin-K-DMA) or analogs thereof, (3aR,5s,6aS)-N,N-dimethyl-2,2-di((9Z,12Z)-octadeca-9,12-dienyl)tetrahydro-3aH-cyclopenta[d][1,3]dioxol-5-amine (ALN100), (6Z,9Z,28Z,31Z)-heptatriaconta-6,9,28,31-tetraen-19-yl 4-(dimethylamino)butanoate (MC3), 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (Tech G1), or a mixture thereof. The cationic lipid can comprise from about 20 mol % to about 50 mol % or about 40 mol % of the total lipid present in the particle.

In another embodiment, the compound 2,2-Dilinoleyl-4-dimethylaminoethyl-[1,3]-dioxolane can be used to prepare lipid-siRNA nanoparticles. Synthesis of 2,2-Dilinoleyl-4-dimethylaminoethyl-[1,3]-dioxolane is described in U.S. provisional patent application No. 61/107,998 filed on Oct. 23, 2008, which is herein incorporated by reference.

In one embodiment, the lipid-siRNA particle includes 40% 2, 2-Dilinoleyl-4-dimethylaminoethyl-[1,3]-dioxolane: 10% DSPC: 40% Cholesterol: 10% PEG-C-DOMG (mole percent) with a particle size of 63.0±20 nm and a 0.027 siRNA/Lipid Ratio.

The ionizable/non-cationic lipid can be an anionic lipid or a neutral lipid including, but not limited to, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoylphosphatidylethanolamine (POPE), dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), distearoyl-phosphatidyl-ethanolamine (DSPE), 16-O-monomethyl PE, 16-O-dimethyl PE, 18-1-trans PE, 1-stearoyl-2-oleoyl-phosphatidyethanolamine (SOPE), cholesterol, or a mixture thereof. The non-cationic lipid can be from about 5 mol % to about 90 mol %, about 10 mol %, or about 58 mol % if cholesterol is included, of the total lipid present in the particle.

The conjugated lipid that inhibits aggregation of particles can be, for example, a polyethyleneglycol (PEG)-lipid including, without limitation, a PEG-diacylglycerol (DAG), a PEG-dialkyloxypropyl (DAA), a PEG-phospholipid, a PEG-ceramide (Cer), or a mixture thereof. The PEG-DAA conjugate can be, for example, a PEG-dilauryloxypropyl ($C_{12}$), a PEG-dimyristyloxypropyl ($C_{14}$), a PEG-dipalmityloxypropyl ($C_{16}$), or a PEG-distearyloxypropyl ($C_{18}$). The conjugated lipid that prevents aggregation of particles can be from 0 mol % to about 20 mol % or about 2 mol % of the total lipid present in the particle.

In some embodiments, the nucleic acid-lipid particle further includes cholesterol at, e.g., about 10 mol % to about 60 mol % or about 48 mol % of the total lipid present in the particle.

In one embodiment, the lipidoid ND98.4HCl (MW 1487) (see U.S. patent application Ser. No. 12/056,230, filed Mar. 26, 2008, which is incorporated herein by reference), Cholesterol (Sigma-Aldrich), and PEG-Ceramide C16 (Avanti Polar Lipids) can be used to prepare lipid-dsRNA nanoparticles (i.e., LNP01 particles). Stock solutions of each in ethanol can be prepared as follows: ND98, 133 mg/ml; Cholesterol, 25 mg/ml, PEG-Ceramide C16, 100 mg/ml. The ND98, Cholesterol, and PEG-Ceramide C16 stock solutions can then be combined in a, e.g., 42:48:10 molar ratio. The combined lipid solution can be mixed with aqueous dsRNA (e.g., in sodium acetate pH 5) such that the final ethanol concentration is about 35-45% and the final sodium acetate concentration is about 100-300 mM. Lipid-dsRNA nanoparticles typically form spontaneously upon mixing. Depending on the desired particle size distribution, the resultant nanoparticle mixture can be extruded through a polycarbonate membrane (e.g., 100 nm cut-off) using, for example, a thermobarrel extruder, such as Lipex Extruder (Northern Lipids, Inc). In some cases, the extrusion step can be omitted. Ethanol removal and simultaneous buffer exchange can be accomplished by, for example, dialysis or tangential flow filtration. Buffer can be exchanged with, for example, phosphate buffered saline (PBS) at about pH 7, e.g., about pH 6.9, about pH 7.0, about pH 7.1, about pH 7.2, about pH 7.3, or about pH 7.4.

Formula 1

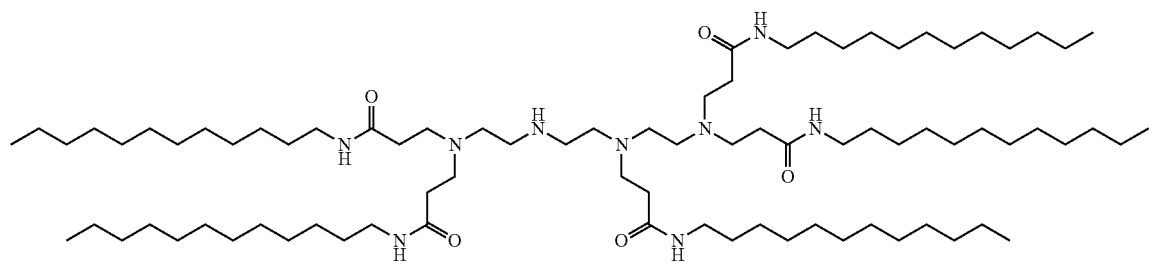

ND98 Isomer I

LNP01 formulations are described, e.g., in International Application Publication No. WO 2008/042973, which is hereby incorporated by reference.

Additional exemplary lipid-dsRNA formulations are described in Table 1.

TABLE 1

|  | Ionizable/Cationic Lipid | cationic lipid/non-cationic lipid/cholesterol/PEG-lipid conjugate Lipid:siRNA ratio |
| --- | --- | --- |
| SNALP-1 | 1,2-Dilinolenyloxy-N,N-dimethylaminopropane (DLinDMA) | DLinDMA/DPPC/Cholesterol/PEG-cDMA (57.1/7.1/34.4/1.4) lipid:siRNA ~7:1 |

TABLE 1-continued

|  | Ionizable/Cationic Lipid | cationic lipid/non-cationic lipid/cholesterol/PEG-lipid conjugate Lipid:siRNA ratio |
|---|---|---|
| 2-XTC | 2,2-Dilinoleyl-4-dimethylaminoethyl-[1,3]-dioxolane (XTC) | XTC/DPPC/Cholesterol/PEG-cDMA 57.1/7.1/34.4/1.4 lipid:siRNA ~7:1 |
| LNP05 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA ~6:1 |
| LNP06 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA ~11:1 |
| LNP07 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA ~6:1 |
| LNP08 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA ~11:1 |
| LNP09 | 2,2-Dilinoleyl-4-dimethylaminoethyl-[1,3]-dioxolane (XTC) | XTC/DSPC/Cholesterol/PEG-DMG 50/10/38.5/1.5 Lipid:siRNA 10:1 |
| LNP10 | (3aR,5s,6aS)-N,N-dimethyl-2,2-di(9Z,12Z)-octadeca-9,12-dienyl)tetrahydro-3aH-cyclopenta[d][1,3]dioxol-5-amine (ALN100) | ALN100/DSPC/Cholesterol/PEG-DMG 50/10/38.5/1.5 Lipid:siRNA 10:1 |
| LNP11 | (6Z,9Z,28Z,31Z)-heptatriaconta-6,9,28,31-tetraen-19-yl 4-(dimethylamino)butanoate (MC3) | MC-3/DSPC/Cholesterol/PEG-DMG 50/10/38.5/1.5 Lipid:siRNA 10:1 |
| LNP12 | 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (Tech G1) | Tech G1/DSPC/Cholesterol/PEG-DMG 50/10/38.5/1.5 Lipid:siRNA 10:1 |
| LNP13 | XTC | XTC/DSPC/Chol/PEG-DMG 50/10/38.5/1.5 Lipid:siRNA: 33:1 |
| LNP14 | MC3 | MC3/DSPC/Chol/PEG-DMG 40/15/40/5 Lipid:siRNA: 11:1 |
| LNP15 | MC3 | MC3/DSPC/Chol/PEG-DSG/GalNAc-PEG-DSG 50/10/35/4.5/0.5 Lipid:siRNA: 11:1 |
| LNP16 | MC3 | MC3/DSPC/Chol/PEG-DMG 50/10/38.5/1.5 Lipid:siRNA: 7:1 |
| LNP17 | MC3 | MC3/DSPC/Chol/PEG-DSG 50/10/38.5/1.5 Lipid:siRNA: 10:1 |
| LNP18 | MC3 | MC3/DSPC/Chol/PEG-DMG 50/10/38.5/1.5 Lipid:siRNA: 12:1 |
| LNP19 | MC3 | MC3/DSPC/Chol/PEG-DMG 50/10/35/5 Lipid:siRNA: 8:1 |
| LNP20 | MC3 | MC3/DSPC/Chol/PEG-DPG 50/10/38.5/1.5 Lipid:siRNA: 10:1 |
| LNP21 | C12-200 | C12-200/DSPC/Chol/PEG-DSG 50/10/38.5/1.5 Lipid:siRNA: 7:1 |

TABLE 1-continued

| | Ionizable/Cationic Lipid | cationic lipid/non-cationic lipid/cholesterol/PEG-lipid conjugate Lipid:siRNA ratio |
|---|---|---|
| LNP22 | XTC | XTC/DSPC/Chol/PEG-DSG 50/10/38.5/1.5 Lipid:siRNA: 10:1 |

DSPC: distearoylphosphatidylcholine
DPPC: dipalmitoylphosphatidylcholine
PEG-DMG: PEG-didimyristoyl glycerol (C14-PEG, or PEG-C14) (PEG with avg mol wt of 2000)
PEG-DSG: PEG-distyryl glycerol (C18-PEG, or PEG-C18) (PEG with avg mol wt of 2000)
PEG-cDMA: PEG-carbamoyl-1,2-dimyristyloxypropylamine (PEG with avg mol wt of 2000) SNALP (1,2-Dilinolenyloxy-N,N-dimethylaminopropane (DLinDMA)) comprising formulations are described in International Publication No. WO2009/127060, filed Apr. 15, 2009, which is hereby incorporated by reference.
XTC comprising formulations are described, e.g., in U.S. Provisional Serial No. 61/148,366, filed Jan. 29, 2009; U.S. Provisional Serial No. 61/156,851, filed Mar. 2, 2009; U.S. Provisional Serial No. filed Jun. 10, 2009; U.S. Provisional Serial No. 61/228,373, filed Jul. 24, 2009; U.S. Provisional Serial No. 61/239,686, filed Sep. 3, 2009, and International Application No. PCT/US2010/022614, filed Jan. 29, 2010, which are hereby incorporated by reference.
MC3 comprising formulations are described, e.g., in U.S. Publication No. 2010/0324120, filed Jun. 10, 2010, the entire contents of which are hereby incorporated by reference.
ALNY-100 comprising formulations are described e.g., International patent application number PCT/US09/63933, filed on Nov. 10, 2009, which is hereby incorporated by reference.
C12-200 comprising formulations are described in U.S. Provisional Serial No. 61/175,770, filed May 5, 2009 and International Application No. PCT/US10/33777, filed May 5, 2010, which are hereby incorporated by reference.

Compositions and formulations for oral administration include powders or granules, microparticulates, nanoparticulates, suspensions or solutions in water or non-aqueous media, capsules, gel capsules, sachets, tablets or minitablets. Thickeners, flavoring agents, diluents, emulsifiers, dispersing aids or binders can be desirable. In some embodiments, oral formulations are those in which dsRNAs featured in the invention are administered in conjunction with one or more penetration enhancer surfactants and chelators. Suitable surfactants include fatty acids and/or esters or salts thereof, bile acids and/or salts thereof. Suitable bile acids/salts include chenodeoxycholic acid (CDCA) and ursodeoxychenodeoxycholic acid (UDCA), cholic acid, dehydrocholic acid, deoxycholic acid, glucholic acid, glycholic acid, glycodeoxycholic acid, taurocholic acid, taurodeoxycholic acid, sodium tauro-24,25-dihydro-fusidate and sodium glycodihydrofusidate. Suitable fatty acids include arachidonic acid, undecanoic acid, oleic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a monoglyceride, a diglyceride or a pharmaceutically acceptable salt thereof (e.g., sodium). In some embodiments, combinations of penetration enhancers are used, for example, fatty acids/salts in combination with bile acids/salts. One exemplary combination is the sodium salt of lauric acid, capric acid and UDCA. Further penetration enhancers include polyoxyethylene-9-lauryl ether, polyoxyethylene-20-cetyl ether. DsRNAs featured in the invention can be delivered orally, in granular form including sprayed dried particles, or complexed to form micro or nanoparticles. DsRNA complexing agents include poly-amino acids; polyimines; polyacrylates; poly-alkylacrylates, polyoxethanes, polyalkylcyanoacrylates; cationized gelatins, albumins, starches, acrylates, polyethyleneglycols (PEG) and starches; polyalkylcyanoacrylates; DEAE-derivatized polyimines, pollulans, celluloses and starches. Suitable complexing agents include chitosan, N-trimethylchitosan, poly-L-lysine, polyhistidine, polyornithine, polyspermines, protamine, polyvinylpyridine, polythiodiethylaminomethylethylene P(TDAE), polyaminostyrene (e.g., p-amino), poly(methylcyanoacrylate), poly(ethylcyanoacrylate), poly(butylcyanoacrylate), poly(isobutylcyanoacrylate), poly(isohexylcynaoacrylate), DEAE-methacrylate, DEAE-hexylacrylate, DEAE-acrylamide, DEAE-albumin and DEAE-dextran, polymethylacrylate, polyhexylacrylate, poly(D,L-lactic acid), poly(DL-lactic-co-glycolic acid (PLGA), alginate, and polyethyleneglycol (PEG). Oral formulations for dsRNAs and their preparation are described in detail in U.S. Pat. No. 6,887,906, US Publn. No. 20030027780, and U.S. Pat. No. 6,747,014, each of which is incorporated herein by reference.

Compositions and formulations for parenteral, intraparenchymal (into the brain), intrathecal, intraventricular or intrahepatic administration can include sterile aqueous solutions which can also contain buffers, diluents and other suitable additives such as, but not limited to, penetration enhancers, carrier compounds and other pharmaceutically acceptable carriers or excipients.

Pharmaceutical compositions of the present invention include, but are not limited to, solutions, emulsions, and liposome-containing formulations. These compositions can be generated from a variety of components that include, but are not limited to, preformed liquids, self-emulsifying solids and self-emulsifying semisolids. Particularly preferred are formulations that target the liver when treating hepatic disorders such as hepatic carcinoma.

The pharmaceutical formulations of the present invention, which can conveniently be presented in unit dosage form, can be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers or finely divided solid carriers or both, and then, if necessary, shaping the product.

The compositions of the present invention can be formulated into any of many possible dosage forms such as, but not limited to, tablets, capsules, gel capsules, liquid syrups, soft gels, suppositories, and enemas. The compositions of the present invention can also be formulated as suspensions in aqueous, non-aqueous or mixed media. Aqueous suspensions can further contain substances which increase the viscosity of the suspension including, for example, sodium carboxymethylcellulose, sorbitol and/or dextran. The suspension can also contain stabilizers.

C. Additional Formulations i. Emulsions

The compositions of the present invention can be prepared and formulated as emulsions. Emulsions are typically heterogeneous systems of one liquid dispersed in another in the form of droplets usually exceeding 0.1 µm in diameter (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions can be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions can contain additional components in addition to the dispersed phases, and the active drug which can be present as a solution in either the aqueous phase, oily phase or itself as a separate phase. Pharmaceutical excipients such as emulsifiers, stabilizers, dyes, and antioxidants can also be present in emulsions as needed. Pharmaceutical emulsions can also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Either of the phases of the emulsion can be a semisolid or a solid, as is the case of emulsion-style ointment bases and creams. Other means of stabilizing emulsions entail the use of emulsifiers that can be incorporated into either phase of the emulsion. Emulsifiers can broadly be classified into four categories: synthetic surfactants, naturally occurring emulsifiers, absorption bases, and finely dispersed solids (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants can be classified into different classes based on the nature of the hydrophilic group: nonionic, anionic, cationic and amphoteric (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y. Rieger, in Pharmaceutical Dosage Forms, Lieberman, Rieger and Banker (Eds.), 1988, Marcel Dekker, Inc., New York, N.Y., volume 1, p. 285).

Naturally occurring emulsifiers used in emulsion formulations include lanolin, beeswax, phosphatides, lecithin and acacia. Absorption bases possess hydrophilic properties such that they can soak up water to form w/o emulsions yet retain their semisolid consistencies, such as anhydrous lanolin and hydrophilic petrolatum. Finely divided solids have also been used as good emulsifiers especially in combination with surfactants and in viscous preparations. These include polar inorganic solids, such as heavy metal hydroxides, nonswelling clays such as bentonite, attapulgite, hectorite, kaolin, montmorillonite, colloidal aluminum silicate and colloidal magnesium aluminum silicate, pigments and nonpolar solids such as carbon or glyceryl tristearate.

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

Hydrophilic colloids or hydrocolloids include naturally occurring gums and synthetic polymers such as polysaccharides (for example, acacia, agar, alginic acid, carrageenan, guar gum, karaya gum, and tragacanth), cellulose derivatives (for example, carboxymethylcellulose and carboxypropylcellulose), and synthetic polymers (for example, carbomers, cellulose ethers, and carboxyvinyl polymers). These disperse or swell in water to form colloidal solutions that stabilize emulsions by forming strong interfacial films around the dispersed-phase droplets and by increasing the viscosity of the external phase.

Since emulsions often contain a number of ingredients such as carbohydrates, proteins, sterols and phosphatides that can readily support the growth of microbes, these formulations often incorporate preservatives. Commonly used preservatives included in emulsion formulations include methyl paraben, propyl paraben, quaternary ammonium salts, benzalkonium chloride, esters of p-hydroxybenzoic acid, and boric acid. Antioxidants are also commonly added to emulsion formulations to prevent deterioration of the formulation. Antioxidants used can be free radical scavengers such as tocopherols, alkyl gallates, butylated hydroxyanisole, butylated hydroxytoluene, or reducing agents such as ascorbic acid and sodium metabisulfite, and antioxidant synergists such as citric acid, tartaric acid, and lecithin.

The application of emulsion formulations via dermatological, oral and parenteral routes and methods for their manufacture have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199). Emulsion formulations for oral delivery have been very widely used because of ease of formulation, as well as efficacy from an absorption and bioavailability standpoint (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245; Idson, in Pharmaceutical Dosage Forms, Lieberman, Rieger and Banker (Eds.), 1988, Marcel Dekker, Inc., New York, N.Y., volume 1, p. 199). Mineral-oil base laxatives, oil-soluble vitamins and high fat nutritive preparations are among the materials that have commonly been administered orally as o/w emulsions.

ii. Microemulsions

In one embodiment of the present invention, the compositions of iRNAs and nucleic acids are formulated as microemulsions. A microemulsion can be defined as a system of water, oil and amphiphile which is a single optically isotropic and thermodynamically stable liquid solution (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245). Typically microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215). Microemulsions commonly are prepared via a combination of three to five components that include oil, water, surfactant, cosurfactant and electrolyte. Whether the microemulsion is of the water-in-oil (w/o) or an oil-in-water (o/w) type is dependent on the properties of the oil and surfactant used and on the structure and geometric packing of the polar heads and hydrocarbon tails of the surfactant molecules (Schott, in Remington's Pharmaceutical Sciences, Mack Publishing Co., Easton, Pa., 1985, p. 271).

The phenomenological approach utilizing phase diagrams has been extensively studied and has yielded a comprehensive knowledge, to one skilled in the art, of how to formulate microemulsions (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245; Block, in Pharmaceutical Dosage Forms, Lieberman, Rieger and Banker (Eds.), 1988, Marcel Dekker, Inc., New York, N.Y., volume 1, p. 335). Compared to conventional emulsions, microemulsions offer the advantage of solubilizing water-insoluble drugs in a formulation of thermodynamically stable droplets that are formed spontaneously.

Surfactants used in the preparation of microemulsions include, but are not limited to, ionic surfactants, non-ionic surfactants, Brij 96, polyoxyethylene oleyl ethers, polyglycerol fatty acid esters, tetraglycerol monolaurate (ML310), tetraglycerol monooleate (MO310), hexaglycerol monooleate (PO310), hexaglycerol pentaoleate (PO500), decaglycerol monocaprate (MCA750), decaglycerol monooleate (MO750), decaglycerol sequioleate (SO750), decaglycerol decaoleate (DAO750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules. Microemulsions can, however, be prepared without the use of cosurfactants and alcohol-free self-emulsifying microemulsion systems are known in the art. The aqueous phase can typically be, but is not limited to, water, an aqueous solution of the drug, glycerol, PEG300, PEG400, polyglycerols, propylene glycols, and derivatives of ethylene glycol. The oil phase can include, but is not limited to, materials such as Captex 300, Captex 355, Capmul MCM, fatty acid esters, medium chain (C8-C12) mono, di, and tri-glycerides, polyoxyethylated glyceryl fatty acid esters, fatty alcohols, polyglycolized glycerides, saturated polyglycolized C8-C10 glycerides, vegetable oils and silicone oil.

Microemulsions are particularly of interest from the standpoint of drug solubilization and the enhanced absorption of drugs. Lipid based microemulsions (both o/w and w/o) have been proposed to enhance the oral bioavailability of drugs, including peptides (see e.g., U.S. Pat. Nos. 6,191,105; 7,063,860; 7,070,802; 7,157,099; Constantinides et al., Pharmaceutical Research, 1994, 11, 1385-1390; Ritschel, Meth. Find. Exp. Clin. Pharmacol., 1993, 13, 205). Microemulsions afford advantages of improved drug solubilization, protection of drug from enzymatic hydrolysis, possible enhancement of drug absorption due to surfactant-induced alterations in membrane fluidity and permeability, ease of preparation, ease of oral administration over solid dosage forms, improved clinical potency, and decreased toxicity (see e.g., U.S. Pat. Nos. 6,191,105; 7,063,860; 7,070,802; 7,157,099; Constantinides et al., Pharmaceutical Research, 1994, 11, 1385; Ho et al., J. Pharm. Sci., 1996, 85, 138-143). Often microemulsions can form spontaneously when their components are brought together at ambient temperature. This can be particularly advantageous when formulating thermolabile drugs, peptides or iRNAs. Microemulsions have also been effective in the transdermal delivery of active components in both cosmetic and pharmaceutical applications. It is expected that the microemulsion compositions and formulations of the present invention will facilitate the increased systemic absorption of iRNAs and nucleic acids from the gastrointestinal tract, as well as improve the local cellular uptake of iRNAs and nucleic acids.

Microemulsions of the present invention can also contain additional components and additives such as sorbitan monostearate (Grill 3), Labrasol, and penetration enhancers to improve the properties of the formulation and to enhance the absorption of the iRNAs and nucleic acids of the present invention. Penetration enhancers used in the microemulsions of the present invention can be classified as belonging to one of five broad categories—surfactants, fatty acids, bile salts, chelating agents, and non-chelating non-surfactants (Lee et al., Critical Reviews in Therapeutic Drug Carrier Systems, 1991, p. 92). Each of these classes has been discussed above.

iii. Microparticles

An iRNA agent of the invention may be incorporated into a particle, e.g., a microparticle. Microparticles can be produced by spray-drying, but may also be produced by other methods including lyophilization, evaporation, fluid bed drying, vacuum drying, or a combination of these techniques.

iv. Penetration Enhancers

In one embodiment, the present invention employs various penetration enhancers to effect the efficient delivery of nucleic acids, particularly iRNAs, to the skin of animals. Most drugs are present in solution in both ionized and nonionized forms. However, usually only lipid soluble or lipophilic drugs readily cross cell membranes. It has been discovered that even non-lipophilic drugs can cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers can be classified as belonging to one of five broad categories, i.e., surfactants, fatty acids, bile salts, chelating agents, and non-chelating non-surfactants (see e.g., Malmsten, M. Surfactants and polymers in drug delivery, Informa Health Care, New York, N.Y., 2002; Lee et al., Critical Reviews in Therapeutic Drug Carrier Systems, 1991, p. 92). Each of the above mentioned classes of penetration enhancers are described below in greater detail.

Surfactants (or "surface-active agents") are chemical entities which, when dissolved in an aqueous solution, reduce the surface tension of the solution or the interfacial tension between the aqueous solution and another liquid, with the result that absorption of iRNAs through the mucosa is enhanced. In addition to bile salts and fatty acids, these penetration enhancers include, for example, sodium lauryl sulfate, polyoxyethylene-9-lauryl ether and polyoxyethylene-20-cetyl ether) (see e.g., Malmsten, M. Surfactants and polymers in drug delivery, Informa Health Care, New York, N.Y., 2002; Lee et al., Critical Reviews in Therapeutic Drug Carrier Systems, 1991, p. 92); and perfluorochemical emulsions, such as FC-43. Takahashi et al., J. Pharm. Pharmacol., 1988, 40, 252).

Various fatty acids and their derivatives which act as penetration enhancers include, for example, oleic acid, lauric acid, capric acid (n-decanoic acid), myristic acid, palmitic acid, stearic acid, linoleic acid, linolenic acid, dicaprate, tricaprate, monoolein (1-monooleoyl-rac-glycerol), dilaurin, caprylic acid, arachidonic acid, glycerol 1-monocaprate, 1-dodecylazacycloheptan-2-one, acylcarnitines, acylcholines, C1-20 alkyl esters thereof (e.g., methyl, isopropyl and t-butyl), and mono- and di-glycerides thereof (i.e., oleate, laurate, caprate, myristate, palmitate, stearate, linoleate, etc.) (see e.g., Touitou, E., et al. Enhancement in Drug Delivery, CRC Press, Danvers, Mass., 2006; Lee et al., Critical Reviews in Therapeutic Drug Carrier Systems, 1991, p. 92; Muranishi, Critical Reviews in Therapeutic Drug Carrier Systems, 1990, 7, 1-33; El Hariri et al., J. Pharm. Pharmacol., 1992, 44, 651-654).

The physiological role of bile includes the facilitation of dispersion and absorption of lipids and fat-soluble vitamins (see e.g., Malmsten, M. Surfactants and polymers in drug delivery, Informa Health Care, New York, N.Y., 2002; Brunton, Chapter 38 in: Goodman & Gilman's The Pharmacological Basis of Therapeutics, 9th Ed., Hardman et al. Eds., McGraw-Hill, New York, 1996, pp. 934-935). Various natural bile salts, and their synthetic derivatives, act as penetration enhancers. Thus the term "bile salts" includes any of the naturally occurring components of bile as well as any of their synthetic derivatives. Suitable bile salts include, for example, cholic acid (or its pharmaceutically acceptable sodium salt, sodium cholate), dehydrocholic acid (sodium dehydrocholate), deoxycholic acid (sodium deoxycholate), glucholic acid (sodium glucholate), glycholic acid (sodium glycocholate), glycodeoxycholic acid (sodium glycodeoxycholate), taurocholic acid (sodium taurocholate), taurodeoxycholic acid (sodium taurodeoxycholate), chenodeoxycholic acid (sodium chenodeoxycholate), ursodeoxycholic acid (UDCA), sodium tauro-24,25-dihydro-fusidate (STDHF), sodium glycodihydrofusidate and polyoxyethylene-9-lauryl ether (POE) (see e.g., Malmsten, M. Surfactants and polymers in drug delivery, Informa Health Care, New York, N.Y., 2002; Lee et al., Critical Reviews in Therapeutic Drug Carrier Systems, 1991, page 92; Swinyard, Chapter 39 In: Remington's Pharmaceutical Sciences, 18th Ed., Gennaro, ed., Mack Publishing Co., Easton, Pa., 1990, pages 782-783; Muranishi, Critical Reviews in Therapeutic Drug Carrier Systems, 1990, 7, 1-33; Yamamoto et al., J. Pharm. Exp. Ther., 1992, 263, 25; Yamashita et al., J. Pharm. Sci., 1990, 79, 579-583).

Chelating agents, as used in connection with the present invention, can be defined as compounds that remove metallic ions from solution by forming complexes therewith, with the result that absorption of iRNAs through the mucosa is enhanced. With regards to their use as penetration enhancers in the present invention, chelating agents have the added advantage of also serving as DNase inhibitors, as most characterized DNA nucleases require a divalent metal ion for catalysis and are thus inhibited by chelating agents (Jarrett, J. Chromatogr., 1993, 618, 315-339). Suitable chelating agents include but are not limited to disodium ethylenediaminetetraacetate (EDTA), citric acid, salicylates (e.g., sodium salicylate, 5-methoxysalicylate and homovanilate), N-acyl derivatives of collagen, laureth-9 and N-amino acyl derivatives of beta-diketones (enamines)(see e.g., Katdare, A. et al., Excipient development for pharmaceutical, biotechnology, and drug delivery, CRC Press, Danvers, Mass., 2006; Lee et al., Critical Reviews in Therapeutic Drug Carrier Systems, 1991, page 92; Muranishi, Critical Reviews in Therapeutic Drug Carrier Systems, 1990, 7, 1-33; Buur et al., J. Control Rel., 1990, 14, 43-51).

As used herein, non-chelating non-surfactant penetration enhancing compounds can be defined as compounds that demonstrate insignificant activity as chelating agents or as surfactants but that nonetheless enhance absorption of iRNAs through the alimentary mucosa (see e.g., Muranishi, Critical Reviews in Therapeutic Drug Carrier Systems, 1990, 7, 1-33). This class of penetration enhancers includes, for example, unsaturated cyclic ureas, 1-alkyl- and 1-alkenylazacyclo-alkanone derivatives (Lee et al., Critical Reviews in Therapeutic Drug Carrier Systems, 1991, page 92); and non-steroidal anti-inflammatory agents such as diclofenac sodium, indomethacin and phenylbutazone (Yamashita et al., J. Pharm. Pharmacol., 1987, 39, 621-626).

Agents that enhance uptake of iRNAs at the cellular level can also be added to the pharmaceutical and other compositions of the present invention. For example, cationic lipids, such as lipofectin (Junichi et al, U.S. Pat. No. 5,705,188), cationic glycerol derivatives, and polycationic molecules, such as polylysine (Lollo et al., PCT Application WO 97/30731), are also known to enhance the cellular uptake of dsRNAs. Examples of commercially available transfection reagents include, for example Lipofectamine™ (Invitrogen;

Carlsbad, Calif.), Lipofectamine 2000™ (Invitrogen; Carlsbad, Calif.), 293Fectin™ (Invitrogen; Carlsbad, Calif.), Cellfectin™ (Invitrogen; Carlsbad, Calif.), DMRIE-C™ (Invitrogen; Carlsbad, Calif.), FreeStyle™ MAX (Invitrogen; Carlsbad, Calif.), Lipofectamine™ 2000 CD (Invitrogen; Carlsbad, Calif.), Lipofectamine™ (Invitrogen; Carlsbad, Calif.), iRNAMAX (Invitrogen; Carlsbad, Calif.), Oligofectamine™ (Invitrogen; Carlsbad, Calif.), Optifect™ (Invitrogen; Carlsbad, Calif.), X-tremeGENE Q2 Transfection Reagent (Roche; Grenzacherstrasse, Switzerland), DOTAP Liposomal Transfection Reagent (Grenzacherstrasse, Switzerland), DOSPER Liposomal Transfection Reagent (Grenzacherstrasse, Switzerland), or Fugene (Grenzacherstrasse, Switzerland), Transfectam® Reagent (Promega; Madison, Wis.), TransFast™ Transfection Reagent (Promega; Madison, Wis.), Tfx™-20 Reagent (Promega; Madison, Wis.), Tfx™-50 Reagent (Promega; Madison, Wis.), DreamFect™ (OZ Biosciences; Marseille, France), EcoTransfect (OZ Biosciences; Marseille, France), TransPass$^a$ D1 Transfection Reagent (New England Biolabs; Ipswich, Mass., USA), LyoVec™/LipoGen™ (Invitrogen; San Diego, Calif., USA), PerFectin Transfection Reagent (Genlantis; San Diego, Calif., USA), NeuroPORTER Transfection Reagent (Genlantis; San Diego, Calif., USA), GenePORTER Transfection reagent (Genlantis; San Diego, Calif., USA), GenePORTER 2 Transfection reagent (Genlantis; San Diego, Calif., USA), Cytofectin Transfection Reagent (Genlantis; San Diego, Calif., USA), BaculoPORTER Transfection Reagent (Genlantis; San Diego, Calif., USA), TroganPORTER™ transfection Reagent (Genlantis; San Diego, Calif., USA), RiboFect (Bioline; Taunton, Mass., USA), PlasFect (Bioline; Taunton, Mass., USA), UniFECTOR (B-Bridge International; Mountain View, Calif., USA), SureFECTOR (B-Bridge International; Mountain View, Calif., USA), or HiFect™ (B-Bridge International, Mountain View, Calif., USA), among others.

Other agents can be utilized to enhance the penetration of the administered nucleic acids, including glycols such as ethylene glycol and propylene glycol, pyrrols such as 2-pyrrol, azones, and terpenes such as limonene and menthone.

v. Carriers

Certain compositions of the present invention also incorporate carrier compounds in the formulation. As used herein, "carrier compound" or "carrier" can refer to a nucleic acid, or analog thereof, which is inert (i.e., does not possess biological activity per se) but is recognized as a nucleic acid by in vivo processes that reduce the bioavailability of a nucleic acid having biological activity by, for example, degrading the biologically active nucleic acid or promoting its removal from circulation. The coadministration of a nucleic acid and a carrier compound, typically with an excess of the latter substance, can result in a substantial reduction of the amount of nucleic acid recovered in the liver, kidney or other extracirculatory reservoirs, presumably due to competition between the carrier compound and the nucleic acid for a common receptor. For example, the recovery of a partially phosphorothioate dsRNA in hepatic tissue can be reduced when it is coadministered with polyinosinic acid, dextran sulfate, polycytidic acid or 4-acetamido-4'isothiocyano-stilbene-2,2'-disulfonic acid (Miyao et al., DsRNA Res. Dev., 1995, 5, 115-121; Takakura et al., DsRNA & Nucl. Acid Drug Dev., 1996, 6, 177-183.

vi. Excipients

In contrast to a carrier compound, a "pharmaceutical carrier" or "excipient" is a pharmaceutically acceptable solvent, suspending agent or any other pharmacologically inert vehicle for delivering one or more nucleic acids to an animal. The excipient can be liquid or solid and is selected, with the planned manner of administration in mind, so as to provide for the desired bulk, consistency, etc., when combined with a nucleic acid and the other components of a given pharmaceutical composition. Typical pharmaceutical carriers include, but are not limited to, binding agents (e.g., pregelatinized maize starch, polyvinylpyrrolidone or hydroxypropyl methylcellulose, etc.); fillers (e.g., lactose and other sugars, microcrystalline cellulose, pectin, gelatin, calcium sulfate, ethyl cellulose, polyacrylates or calcium hydrogen phosphate, etc.); lubricants (e.g., magnesium stearate, talc, silica, colloidal silicon dioxide, stearic acid, metallic stearates, hydrogenated vegetable oils, corn starch, polyethylene glycols, sodium benzoate, sodium acetate, etc.); disintegrants (e.g., starch, sodium starch glycolate, etc.); and wetting agents (e.g., sodium lauryl sulphate, etc).

Pharmaceutically acceptable organic or inorganic excipients suitable for non-parenteral administration which do not deleteriously react with nucleic acids can also be used to formulate the compositions of the present invention. Suitable pharmaceutically acceptable carriers include, but are not limited to, water, salt solutions, alcohols, polyethylene glycols, gelatin, lactose, amylose, magnesium stearate, talc, silicic acid, viscous paraffin, hydroxymethylcellulose, polyvinylpyrrolidone and the like.

Formulations for topical administration of nucleic acids can include sterile and non-sterile aqueous solutions, non-aqueous solutions in common solvents such as alcohols, or solutions of the nucleic acids in liquid or solid oil bases. The solutions can also contain buffers, diluents and other suitable additives. Pharmaceutically acceptable organic or inorganic excipients suitable for non-parenteral administration which do not deleteriously react with nucleic acids can be used.

Suitable pharmaceutically acceptable excipients include, but are not limited to, water, salt solutions, alcohol, polyethylene glycols, gelatin, lactose, amylose, magnesium stearate, talc, silicic acid, viscous paraffin, hydroxymethylcellulose, polyvinylpyrrolidone and the like.

vii. Other Components

The compositions of the present invention can additionally contain other adjunct components conventionally found in pharmaceutical compositions, at their art-established usage levels. Thus, for example, the compositions can contain additional, compatible, pharmaceutically-active materials such as, for example, antipruritics, astringents, local anesthetics or anti-inflammatory agents, or can contain additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings and/or aromatic substances and the like which do not deleteriously interact with the nucleic acid(s) of the formulation.

Aqueous suspensions can contain substances which increase the viscosity of the suspension including, for example, sodium carboxymethylcellulose, sorbitol and/or dextran. The suspension can also contain stabilizers.

In some embodiments, pharmaceutical compositions featured in the invention include (a) one or more iRNA compounds and (b) one or more agents which function by a non-iRNA mechanism and which are useful in treating a hemolytic disorder. Examples of such agents include, but are not limited to an anti-inflammatory agent, anti-steatosis agent, antiviral, and/or anti-fibrosis agent.

In addition, other substances commonly used to protect the liver, such as silymarin, can also be used in conjunction with the iRNAs described herein. Other agents useful for treating liver diseases include telbivudine, entecavir, and protease inhibitors such as telaprevir and other disclosed, for example, in Tung et al., U.S. Application Publication Nos. 2005/0148548, 2004/0167116, and 2003/0144217; and in Hale et al., U.S. Application Publication No. 2004/0127488.

Toxicity and therapeutic efficacy of such compounds can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compounds that exhibit high therapeutic indices are preferred.

The data obtained from cell culture assays and animal studies can be used in formulating a range of dosage for use in humans. The dosage of compositions featured herein in the invention lies generally within a range of circulating concentrations that include the ED50 with little or no toxicity. The dosage can vary within this range depending upon the dosage form employed and the route of administration utilized. For any compound used in the methods featured in the invention, the therapeutically effective dose can be estimated initially from cell culture assays. A dose can be formulated in animal models to achieve a circulating plasma concentration range of the compound or, when appropriate, of the polypeptide product of a target sequence (e.g., achieving a decreased concentration of the polypeptide) that includes the IC50 (i.e., the concentration of the test compound which achieves a half-maximal inhibition of symptoms) as determined in cell culture. Such information can be used to more accurately determine useful doses in humans. Levels in plasma can be measured, for example, by high performance liquid chromatography.

In addition to their administration, as discussed above, the iRNAs featured in the invention can be administered in combination with other known agents effective in treatment of pathological processes mediated by PNPLA3 expression. In any event, the administering physician can adjust the amount and timing of iRNA administration on the basis of results observed using standard measures of efficacy known in the art or described herein.

VII. Methods for Inhibiting PNPLA3 Expression

The present invention also provides methods of inhibiting expression of a PNPLA3 gene in a cell. The methods include contacting a cell with an RNAi agent, e.g., double stranded RNAi agent, in an amount effective to inhibit expression of PNPLA3 in the cell, thereby inhibiting expression of PNPLA3 in the cell.

Contacting of a cell with an RNAi agent, e.g., a double stranded RNAi agent, may be done in vitro or in vivo. Contacting a cell in vivo with the RNAi agent includes contacting a cell or group of cells within a subject, e.g., a human subject, with the RNAi agent. Combinations of in vitro and in vivo methods of contacting a cell are also possible. Contacting a cell may be direct or indirect, as discussed above. Furthermore, contacting a cell may be accomplished via a targeting ligand, including any ligand described herein or known in the art. In preferred embodiments, the targeting ligand is a carbohydrate moiety, e.g., a GalNAc$_3$ ligand, or any other ligand that directs the RNAi agent to a site of interest.

In one embodiment, contacting a cell with an iRNA includes "introducing" or "delivering the iRNA into the cell" by facilitating or effecting uptake or absorption into the cell. Absorption or uptake of an iRNA can occur through unaided diffusive or active cellular processes, or by auxiliary agents or devices. Introducing an iRNA into a cell may be in vitro and/or in vivo. For example, for in vivo introduction, iRNA can be injected into a tissue site or administered systemically. In vitro introduction into a cell includes methods known in the art such as electroporation and lipofection. Further approaches are described herein below and/or are known in the art.

The term "inhibiting," as used herein, is used interchangeably with "reducing," "silencing," "downregulating", "suppressing", and other similar terms, and includes any level of inhibition.

The phrase "inhibiting expression of a PNPLA3" is intended to refer to inhibition of expression of any PNPLA3 gene (such as, e.g., a mouse PNPLA3 gene, a rat PNPLA3 gene, a monkey PNPLA3 gene, or a human PNPLA3 gene) as well as variants or mutants of a PNPLA3 gene. Thus, the PNPLA3 gene may be a wild-type PNPLA3 gene, a mutant PNPLA3 gene (such as a mutant PNPLA3 gene giving rise to amyloid deposition), or a transgenic PNPLA3 gene in the context of a genetically manipulated cell, group of cells, or organism.

"Inhibiting expression of a PNPLA3 gene" includes any level of inhibition of a PNPLA3 gene, e.g., at least partial suppression of the expression of a PNPLA3 gene. The expression of the PNPLA3 gene may be assessed based on the level, or the change in the level, of any variable associated with PNPLA3 gene expression, e.g., PNPLA3 mRNA level, PNPLA3 protein level, or the number or extent of amyloid deposits. This level may be assessed in an individual cell or in a group of cells, including, for example, a sample derived from a subject.

Inhibition may be assessed by a decrease in an absolute or relative level of one or more variables that are associated with PNPLA3 expression compared with a control level. The control level may be any type of control level that is utilized in the art, e.g., a pre-dose baseline level, or a level determined from a similar subject, cell, or sample that is untreated or treated with a control (such as, e.g., buffer only control or inactive agent control).

In some embodiments of the methods of the invention, expression of a PNPLA3 gene is inhibited by at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%. at least about 95%, at least about 96%, at least about 97%, at least about 98%, or at least about 99%.

Inhibition of the expression of a PNPLA3 gene may be manifested by a reduction of the amount of mRNA expressed by a first cell or group of cells (such cells may be present, for example, in a sample derived from a subject) in which a PNPLA3 gene is transcribed and which has or have been treated (e.g., by contacting the cell or cells with an RNAi agent of the invention, or by administering an RNAi agent of the invention to a subject in which the cells are or were present) such that the expression of a PNPLA3 gene is inhibited, as compared to a second cell or group of cells substantially identical to the first cell or group of cells but which has not or have not been so treated (control cell(s)). In preferred embodiments, the inhibition is assessed by expressing the level of mRNA in treated cells as a percentage of the level of mRNA in control cells, using the following formula:

$$\frac{(mRNA \text{ in control cells}) - (mRNA \text{ in treated cells})}{(mRNA \text{ in control cells})} \cdot 100\%$$

Alternatively, inhibition of the expression of a PNPLA3 gene may be assessed in terms of a reduction of a parameter that is functionally linked to PNPLA3 gene expression, e.g., PNPLA3 protein expression or Hedgehog pathway protein activities. PNPLA3 gene silencing may be determined in any cell expressing PNPLA3, either constitutively or by genomic engineering, and by any assay known in the art.

Inhibition of the expression of a PNPLA3 protein may be manifested by a reduction in the level of the PNPLA3 protein that is expressed by a cell or group of cells (e.g., the level of protein expressed in a sample derived from a subject). As explained above, for the assessment of mRNA suppression, the inhibition of protein expression levels in a treated cell or group of cells may similarly be expressed as a percentage of the level of protein in a control cell or group of cells.

A control cell or group of cells that may be used to assess the inhibition of the expression of a PNPLA3 gene includes a cell or group of cells that has not yet been contacted with an RNAi agent of the invention. For example, the control cell or group of cells may be derived from an individual subject (e.g., a human or animal subject) prior to treatment of the subject with an RNAi agent.

The level of PNPLA3 mRNA that is expressed by a cell or group of cells, or the level of circulating PNPLA3 mRNA, may be determined using any method known in the art for assessing mRNA expression. In one embodiment, the level of expression of PNPLA3 in a sample is determined by detecting a transcribed polynucleotide, or portion thereof, e.g., mRNA of the PNPLA3 gene. RNA may be extracted from cells using RNA extraction techniques including, for example, using acid phenol/guanidine isothiocyanate extraction (RNAzol B; Biogenesis), RNeasy RNA preparation kits (Qiagen) or PAXgene (PreAnalytix, Switzerland). Typical assay formats utilizing ribonucleic acid hybridization include nuclear run-on assays, RT-PCR, RNase protection assays (Melton et al., *Nuc. Acids Res.* 12:7035), Northern blotting, in situ hybridization, and microarray analysis. Circulating PNPLA3 mRNA may be detected using methods the described in PCT/US2012/043584, the entire contents of which are hereby incorporated herein by reference.

In one embodiment, the level of expression of PNPLA3 is determined using a nucleic acid probe. The term "probe", as used herein, refers to any molecule that is capable of selectively binding to a specific PNPLA3. Probes can be synthesized by one of skill in the art, or derived from appropriate biological preparations. Probes may be specifically designed to be labeled. Examples of molecules that can be utilized as probes include, but are not limited to, RNA, DNA, proteins, antibodies, and organic molecules.

Isolated mRNA can be used in hybridization or amplification assays that include, but are not limited to, Southern or Northern analyses, polymerase chain reaction (PCR) analyses and probe arrays. One method for the determination of mRNA levels involves contacting the isolated mRNA with a nucleic acid molecule (probe) that can hybridize to PNPLA3 mRNA. In one embodiment, the mRNA is immobilized on a solid surface and contacted with a probe, for example by running the isolated mRNA on an agarose gel and transferring the mRNA from the gel to a membrane, such as nitrocellulose. In an alternative embodiment, the probe(s) are immobilized on a solid surface and the mRNA is contacted with the probe(s), for example, in an Affymetrix gene chip array. A skilled artisan can readily adapt known mRNA detection methods for use in determining the level of PNPLA3 mRNA.

An alternative method for determining the level of expression of PNPLA3 in a sample involves the process of nucleic acid amplification and/or reverse transcriptase (to prepare cDNA) of for example mRNA in the sample, e.g., by RT-PCR (the experimental embodiment set forth in Mullis, 1987, U.S. Pat. No. 4,683,202), ligase chain reaction (Barany (1991) *Proc. Natl. Acad. Sci. USA* 88:189-193), self sustained sequence replication (Guatelli et al. (1990) *Proc. Natl. Acad. Sci. USA* 87:1874-1878), transcriptional amplification system (Kwoh et al. (1989) *Proc. Natl. Acad. Sci. USA* 86:1173-1177), Q-Beta Replicase (Lizardi et al. (1988) *Bio/Technology* 6:1197), rolling circle replication (Lizardi et al., U.S. Pat. No. 5,854,033) or any other nucleic acid amplification method, followed by the detection of the amplified molecules using techniques well known to those of skill in the art. These detection schemes are especially useful for the detection of nucleic acid molecules if such molecules are present in very low numbers. In particular aspects of the invention, the level of expression of PNPLA3 is determined by quantitative fluorogenic RT-PCR (i.e., the TaqMan™ System).

The expression levels of PNPLA3 mRNA may be monitored using a membrane blot (such as used in hybridization analysis such as Northern, Southern, dot, and the like), or microwells, sample tubes, gels, beads or fibers (or any solid support comprising bound nucleic acids). See U.S. Pat. Nos. 5,770,722, 5,874,219, 5,744,305, 5,677,195 and 5,445,934, which are incorporated herein by reference. The determination of PNPLA3 expression level may also comprise using nucleic acid probes in solution.

In preferred embodiments, the level of mRNA expression is assessed using branched DNA (bDNA) assays or real time PCR (qPCR). The use of these methods is described and exemplified in the Examples presented herein.

The level of PNPLA3 protein expression may be determined using any method known in the art for the measurement of protein levels. Such methods include, for example, electrophoresis, capillary electrophoresis, high performance liquid chromatography (HPLC), thin layer chromatography (TLC), hyperdiffusion chromatography, fluid or gel precipitin reactions, absorption spectroscopy, a colorimetric assays, spectrophotometric assays, flow cytometry, immunodiffusion (single or double), immunoelectrophoresis, Western blotting, radioimmunoassay (RIA), enzyme-linked immunosorbent assays (ELISAs), immunofluorescent assays, electrochemiluminescence assays, and the like.

In some embodiments, the efficacy of the methods of the invention can be monitored by detecting or monitoring a reduction in a symptom of a PNPLA3 disease, such as reduction in edema swelling of the extremities, face, larynx, upper respiratory tract, abdomen, trunk, and genitals, prodrome; laryngeal swelling; nonpruritic rash; nausea; vomiting; or abdominal pain. These symptoms may be assessed in vitro or in vivo using any method known in the art.

In some embodiments of the methods of the invention, the RNAi agent is administered to a subject such that the RNAi agent is delivered to a specific site within the subject. The inhibition of expression of PNPLA3 may be assessed using measurements of the level or change in the level of PNPLA3 mRNA or PNPLA3 protein in a sample derived from fluid or tissue from the specific site within the subject. In preferred embodiments, the site is selected from the group consisting of liver, choroid plexus, retina, and pancreas. The site may also be a subsection or subgroup of cells from any one of the aforementioned sites. The site may also include cells that express a particular type of receptor.

VIII. Methods of Treating or Preventing PNPLA3-Associated Diseases

The present invention provides therapeutic and prophylactic methods which include administering to a subject with a PNPLA3-associated disease, disorder, and/or condition, or prone to developing, a PNPLA3-associated disease, disorder, and/or condition, compositions comprising an iRNA agent, or pharmaceutical compositions comprising an iRNA agent, or vectors comprising an iRNA of the invention. Non-limiting examples of PNPLA3-associated diseases include, for example, fatty liver (steatosis), nonalcoholic steatohepatitis (NASH), cirrhosis of the liver, accumulation of fat in the liver, inflammation of the liver, hepatocellular necrosis, liver fibrosis, obesity, or nonalcoholic fatty liver disease (NAFLD). In one embodiment, the PNPLA3-associated disease is NAFLD. In another embodiment, the PNPLA3-associated disease is NASH. In another embodiment, the PNPLA3-associated disease is fatty liver (steatosis). In another embodiment, the PNPLA3-associated disease is insulin resistance. In another embodiment, the PNPLA3-associated disease is enot insulin resistance.

The methods of the invention are useful for treating a subject having a PNPLA3-associated disease, e.g., a subject that would benefit from reduction in PNPLA3 gene expression and/or PNPLA3 protein production. In one aspect, the present invention provides methods of reducing the level of Patatin-Like Phospholipase Domain Containing 3 (PNPLA3) gene expression in a subject having nonalcoholic fatty liver disease (NAFLD). In another aspect, the present invention provides methods of reducing the level of PNPLA3 protein in a subject with NAFLD. The present invention also provides methods of reducing the level of activity of the hedgehog pathway in a subject with NAFLD.

In another aspect, the present invention provides methods of treating a subject having an NAFLD. In one aspect, the present invention provides methods of treating a subject having an PNPLA3-associated disease, e.g., fatty liver (steatosis), nonalcoholic steatohepatitis (NASH), cirrhosis of the liver, accumulation of fat in the liver, inflammation of the liver, hepatocellular necrosis, liver fibrosis, obesity, or nonalcoholic fatty liver disease (NAFLD). The treatment methods (and uses) of the invention include administering to the subject, e.g., a human, a therapeutically effective amount of an iRNA agent of the invention targeting a PNPLA3 gene or a pharmaceutical composition comprising an iRNA agent of the invention targeting a PNPLA3 gene or a vector of the invention comprising an iRNA agent targeting an PNPLA3 gene.

In one aspect, the invention provides methods of preventing at least one symptom in a subject having NAFLD, e.g., the presence of elevated hedgehog signaling pathways, fatigue, weakness, weight loss, loss of apetite, nausea, abdominal pain, spider-like blood vessels, yellowing of the skin and eyes (jaundice), itching, fluid build up and swelling of the legs (edema), abdomen swelling (ascites), and mental confusion. The methods include administering to the subject a therapeutically effective amount of the iRNA agent, e.g. dsRNA, pharmaceutical compositions, or vectors of the invention, thereby preventing at least one symptom in the subject having a disorder that would benefit from reduction in PNPLA3 gene expression.

In another aspect, the present invention provides uses of a therapeutically effective amount of an iRNA agent of the invention for treating a subject, e.g., a subject that would benefit from a reduction and/or inhibition of PNPLA3 gene expression.

In a further aspect, the present invention provides uses of an iRNA agent, e.g., a dsRNA, of the invention targeting an PNPLA3 gene or pharmaceutical composition comprising an iRNA agent targeting an PNPLA3 gene in the manufacture of a medicament for treating a subject, e.g., a subject that would benefit from a reduction and/or inhibition of PNPLA3 gene expression and/or PNPLA3 protein production, such as a subject having a disorder that would benefit from reduction in PNPLA3 gene expression, e.g., a PNPLA3-associated disease.

In another aspect, the invention provides uses of an iRNA, e.g., a dsRNA, of the invention for preventing at least one symptom in a subject suffering from a disorder that would benefit from a reduction and/or inhibition of PNPLA3 gene expression and/or PNPLA3 protein production.

In a further aspect, the present invention provides uses of an iRNA agent of the invention in the manufacture of a medicament for preventing at least one symptom in a subject suffering from a disorder that would benefit from a reduction and/or inhibition of PNPLA3 gene expression and/or SCAP protein production, such as a PNPLA3-associated disease.

In one embodiment, an iRNA agent targeting PNPLA3 is administered to a subject having a PNPLA3-associated disease, e.g., nonalcoholic fatty liver disease (NAFLD), such that the expression of a PNPLA3 gene, e.g., in a cell, tissue, blood or other tissue or fluid of the subject are reduced by at least about 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 62%, 64%, 65%, 66%, 67%, 68%, 69%, 70%, 71%, 72%, 723%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or at least about 99% or more when the dsRNA agent is administered to the subject.

The methods and uses of the invention include administering a composition described herein such that expression of the target PNPLA3 gene is decreased, such as for about 1, 2, 3, 4 5, 6, 7, 8, 12, 16, 18, 24, 28, 32, 36, 40, 44, 48, 52, 56, 60, 64, 68, 72, 76, or about 80 hours. In one embodiment, expression of the target PNPLA3 gene is decreased for an extended duration, e.g., at least about two, three, four, five, six, seven days or more, e.g., about one week, two weeks, three weeks, or about four weeks or longer.

Administration of the dsRNA according to the methods and uses of the invention may result in a reduction of the severity, signs, symptoms, and/or markers of such diseases or disorders in a patient with a PNPLA3-associated disease, e.g., nonalcoholic fatty liver disease (NAFLD). By "reduction" in this context is meant a statistically significant decrease in such level. The reduction can be, for example, at least about 5%, 10%, 15%, 20%, 25%, 30%, 35%, 40%, 45%, 50%, 55%, 60%, 65%, 70%, 75%, 80%, 85%, 90%, 95%, or about 100%.

Efficacy of treatment or prevention of disease can be assessed, for example by measuring disease progression, disease remission, symptom severity, reduction in pain, quality of life, dose of a medication required to sustain a treatment effect, level of a disease marker or any other measurable parameter appropriate for a given disease being treated or targeted for prevention. It is well within the ability of one skilled in the art to monitor efficacy of treatment or prevention by measuring any one of such parameters, or any combination of parameters. For example, efficacy of treatment of NAFLD may be assessed, for example, by periodic monitoring of NAFLD symptoms, liver fat levels, or expression of downstream genes. Comparison of the later readings with the initial readings provide a physician an indication of whether the treatment is effective. It is well within the ability of one skilled in the art to monitor efficacy of treatment or prevention by measuring any one of such parameters, or any combination of parameters. In connection with the administration of an iRNA targeting PNPLA3 or pharmaceutical composition thereof, "effective against" an PNPLA3-associated disease indicates that administration in a clinically appropriate manner results in a beneficial effect for at least a statistically significant fraction of patients, such as improvement of symptoms, a cure, a reduction in disease, extension of life, improvement in quality of life, or other effect generally recognized as positive by medical doctors familiar with treating NAFLD and/or an PNPLA3-associated disease and the related causes.

A treatment or preventive effect is evident when there is a statistically significant improvement in one or more parameters of disease status, or by a failure to worsen or to develop symptoms where they would otherwise be anticipated. As an example, a favorable change of at least 10% in a measurable parameter of disease, and preferably at least 20%, 30%, 40%, 50% or more can be indicative of effective treatment. Efficacy for a given iRNA drug or formulation of that drug can also be judged using an experimental animal model for the given disease as known in the art. When using an experimental animal model, efficacy of treatment is evidenced when a statistically significant reduction in a marker or symptom is observed.

Subjects can be administered a therapeutic amount of iRNA, such as about 0.01 mg/kg, 0.02 mg/kg, 0.03 mg/kg, 0.04 mg/kg, 0.05 mg/kg, 0.1 mg/kg, 0.15 mg/kg, 0.2 mg/kg, 0.25 mg/kg, 0.3 mg/kg, 0.35 mg/kg, 0.4 mg/kg, 0.45 mg/kg, 0.5 mg/kg, 0.55 mg/kg, 0.6 mg/kg, 0.65 mg/kg, 0.7 mg/kg, 0.75 mg/kg, 0.8 mg/kg, 0.85 mg/kg, 0.9 mg/kg, 0.95 mg/kg, 1.0 mg/kg, 1.1 mg/kg, 1.2 mg/kg, 1.3 mg/kg, 1.4 mg/kg, 1.5 mg/kg, 1.6 mg/kg, 1.7 mg/kg, 1.8 mg/kg, 1.9 mg/kg, 2.0 mg/kg, 2.1 mg/kg, 2.2 mg/kg, 2.3 mg/kg, 2.4 mg/kg, 2.5 mg/kg dsRNA, 2.6 mg/kg dsRNA, 2.7 mg/kg dsRNA, 2.8 mg/kg dsRNA, 2.9 mg/kg dsRNA, 3.0 mg/kg dsRNA, 3.1 mg/kg dsRNA, 3.2 mg/kg dsRNA, 3.3 mg/kg dsRNA, 3.4 mg/kg dsRNA, 3.5 mg/kg dsRNA, 3.6 mg/kg dsRNA, 3.7 mg/kg dsRNA, 3.8 mg/kg dsRNA, 3.9 mg/kg dsRNA, 4.0 mg/kg dsRNA, 4.1 mg/kg dsRNA, 4.2 mg/kg dsRNA, 4.3 mg/kg dsRNA, 4.4 mg/kg dsRNA, 4.5 mg/kg dsRNA, 4.6 mg/kg dsRNA, 4.7 mg/kg dsRNA, 4.8 mg/kg dsRNA, 4.9 mg/kg dsRNA, 5.0 mg/kg dsRNA, 5.1 mg/kg dsRNA, 5.2 mg/kg dsRNA, 5.3 mg/kg dsRNA, 5.4 mg/kg dsRNA, 5.5 mg/kg dsRNA, 5.6 mg/kg dsRNA, 5.7 mg/kg dsRNA, 5.8 mg/kg dsRNA, 5.9 mg/kg dsRNA, 6.0 mg/kg dsRNA, 6.1 mg/kg dsRNA, 6.2 mg/kg dsRNA, 6.3 mg/kg dsRNA, 6.4 mg/kg dsRNA, 6.5 mg/kg dsRNA, 6.6 mg/kg dsRNA, 6.7 mg/kg dsRNA, 6.8 mg/kg dsRNA, 6.9 mg/kg dsRNA, 7.0 mg/kg dsRNA, 7.1 mg/kg dsRNA, 7.2 mg/kg dsRNA, 7.3 mg/kg dsRNA, 7.4 mg/kg dsRNA, 7.5 mg/kg dsRNA, 7.6 mg/kg dsRNA, 7.7 mg/kg dsRNA, 7.8 mg/kg dsRNA, 7.9 mg/kg dsRNA, 8.0 mg/kg dsRNA, 8.1 mg/kg dsRNA, 8.2 mg/kg dsRNA, 8.3 mg/kg dsRNA, 8.4 mg/kg dsRNA, 8.5 mg/kg dsRNA, 8.6 mg/kg dsRNA, 8.7 mg/kg dsRNA, 8.8 mg/kg dsRNA, 8.9 mg/kg dsRNA, 9.0 mg/kg dsRNA, 9.1 mg/kg dsRNA, 9.2 mg/kg dsRNA, 9.3 mg/kg dsRNA, 9.4 mg/kg dsRNA, 9.5 mg/kg dsRNA, 9.6 mg/kg dsRNA, 9.7 mg/kg dsRNA, 9.8 mg/kg dsRNA, 9.9 mg/kg dsRNA, 9.0 mg/kg dsRNA, 10 mg/kg dsRNA, 15 mg/kg dsRNA, 20 mg/kg dsRNA, 25 mg/kg dsRNA, 30 mg/kg dsRNA, 35 mg/kg dsRNA, 40 mg/kg dsRNA, 45 mg/kg dsRNA, or about 50 mg/kg dsRNA. In one embodiment, subjects can be administered 0.5 mg/kg of the dsRNA. Values and ranges intermediate to the recited values are also intended to be part of this invention.

Administration of the iRNA can reduce the presence of PNPLA3 protein levels, e.g., in a cell, tissue, blood, urine or other compartment of the patient by at least about 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 74%, 76%, 77%, 78%, 81%, 82%, 83%, 84%, 85%, 86%, 87%, 88%, 89%, 90%, 91%, 92%, 93%, 94%, 95%, 96%, 97%, 98%, or at least about 99% or more.

Before administration of a full dose of the iRNA, patients can be administered a smaller dose, such as a 5% infusion, and monitored for adverse effects, such as an allergic reaction. In another example, the patient can be monitored for unwanted immunostimulatory effects, such as increased cytokine (e.g., TNF-alpha or INF-alpha) levels.

Owing to the inhibitory effects on PNPLA3 expression, a composition according to the invention or a pharmaceutical composition prepared therefrom can enhance the quality of life.

An iRNA of the invention may be administered in "naked" form, where the modified or unmodified iRNA agent is directly suspended in aqueous or suitable buffer solvent, as a "free iRNA." A free iRNA is administered in the absence of a pharmaceutical composition. The free iRNA may be in a suitable buffer solution. The buffer solution may comprise acetate, citrate, prolamine, carbonate, or phosphate, or any combination thereof. In one embodiment, the buffer solution is phosphate buffered saline (PBS). The pH and osmolarity of the buffer solution containing the iRNA can be adjusted such that it is suitable for administering to a subject.

Alternatively, an iRNA of the invention may be administered as a pharmaceutical composition, such as a dsRNA liposomal formulation.

Subjects that would benefit from a reduction and/or inhibition of PNPLA3 gene expression are those having nonalcoholic fatty liver disease (NAFLD) and/or an PNPLA3-associated disease or disorder as described herein.

Treatment of a subject that would benefit from a reduction and/or inhibition of PNPLA3 gene expression includes therapeutic and prophylactic treatment.

The invention further provides methods and uses of an iRNA agent or a pharmaceutical composition thereof for treating a subject that would benefit from reduction and/or inhibition of PNPLA3 gene expression, e.g., a subject having a PNPLA3-associated disease, in combination with other pharmaceuticals and/or other therapeutic methods, e.g., with known pharmaceuticals and/or known therapeutic methods, such as, for example, those which are currently employed for treating these disorders.

For example, in certain embodiments, an iRNA targeting a PNPLA3 gene is administered in combination with, e.g., an agent useful in treating an PNPLA3-associated disease as described elsewhere herein. For example, additional therapeutics and therapeutic methods suitable for treating a subject that would benefit from reduction in PNPLA3 expression, e.g., a subject having a PNPLA3-associated disease, include an iRNA agent targeting a different portion of the PNPLA3 gene, a therapeutic agent, and/or procedures for treating a PNPLA3-associated disease or a combination of any of the foregoing.

In certain embodiments, a first iRNA agent targeting a PNPLA3 gene is administered in combination with a second iRNA agent targeting a different portion of the PNPLA3 gene. For example, the first RNAi agent comprises a first sense strand and a first antisense strand forming a double stranded region, wherein substantially all of the nucleotides of said first sense strand and substantially all of the nucleotides of the first antisense strand are modified nucleotides, wherein said first sense strand is conjugated to a ligand attached at the 3'-terminus, and wherein the ligand is one or more GalNAc derivatives attached through a bivalent or trivalent branched linker; and the second RNAi agent comprises a second sense strand and a second antisense strand forming a double stranded region, wherein substantially all of the nucleotides of the second sense strand and substantially all of the nucleotides of the second antisense strand are modified nucleotides, wherein the second sense strand is conjugated to a ligand attached at the 3'-terminus, and wherein the ligand is one or more GalNAc derivatives attached through a bivalent or trivalent branched linker.

In one embodiment, all of the nucleotides of the first and second sense strand and/or all of the nucleotides of the first and second antisense strand comprise a modification.

In one embodiment, the at least one of the modified nucleotides is selected from the group consisting of a 3'-terminal deoxy-thymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxly-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, and a nucleotide comprising a 5'-phosphate mimic.

In certain embodiments, a first iRNA agent targeting a PNPLA3 gene is administered in combination with a second iRNA agent targeting a gene that is different from the PNPLA3 gene. For example, the iRNA agent targeting the PNPLA3 gene may be administered in combination with an iRNA agent targeting the SCAP gene. The first iRNA agent targeting a PNPLA3 gene and the second iRNA agent targeting a gene different from the PNPLA3 gene, e.g., the SCAP gene, may be administered as parts of the same pharmaceutical composition. Alternatively, the first iRNA agent targeting a PNPLA3 gene and the second iRNA agent targeting a gene different from the PNPLA3 gene, e.g., the SCAP gene, may be administered as parts of different pharmaceutical compositions.

The iRNA agent and an additional therapeutic agent and/or treatment may be administered at the same time and/or in the same combination, e.g., parenterally, or the additional therapeutic agent can be administered as part of a separate composition or at separate times and/or by another method known in the art or described herein.

The present invention also provides methods of using an iRNA agent of the invention and/or a composition containing an iRNA agent of the invention to reduce and/or inhibit PNPLA3 expression in a cell. In other aspects, the present invention provides an iRNA of the invention and/or a composition comprising an iRNA of the invention for use in reducing and/or inhibiting PNPLA3 gene expression in a cell. In yet other aspects, use of an iRNA of the invention and/or a composition comprising an iRNA of the invention for the manufacture of a medicament for reducing and/or inhibiting PNPLA3 gene expression in a cell are provided. In still other aspects, the present invention provides an iRNA of the invention and/or a composition comprising an iRNA of the invention for use in reducing and/or inhibiting PNPLA3 protein production in a cell. In yet other aspects, use of an iRNA of the invention and/or a composition comprising an iRNA of the invention for the manufacture of a medicament for reducing and/or inhibiting PNPLA3 protein production in a cell are provided. The methods and uses include contacting the cell with an iRNA, e.g., a dsRNA, of the invention and maintaining the cell for a time sufficient to obtain degradation of the mRNA transcript of an PNPLA3 gene, thereby inhibiting expression of the PNPLA3 gene or inhibiting PNPLA3 protein production in the cell.

Reduction in gene expression can be assessed by any methods known in the art. For example, a reduction in the expression of PNPLA3 may be determined by determining the mRNA expression level of PNPLA3 using methods routine to one of ordinary skill in the art, e.g., Northern blotting, qRT-PCR, by determining the protein level of PNPLA3 using methods routine to one of ordinary skill in the art, such as Western blotting, immunological techniques, flow cytometry methods, ELISA, and/or by determining a biological activity of PNPLA3.

In the methods and uses of the invention the cell may be contacted in vitro or in vivo, i.e., the cell may be within a subject.

A cell suitable for treatment using the methods of the invention may be any cell that expresses an PNPLA3 gene, e.g., a cell from a subject having NAFLD or a cell comprising an expression vector comprising a PNPLA3 gene or portion of a PNPLA3 gene. A cell suitable for use in the methods and uses of the invention may be a mammalian cell, e.g., a primate cell (such as a human cell or a non-human primate cell, e.g., a monkey cell or a chimpanzee cell), a non-primate cell (such as a cow cell, a pig cell, a camel cell, a llama cell, a horse cell, a goat cell, a rabbit cell, a sheep cell, a hamster, a guinea pig cell, a cat cell, a dog cell, a rat cell, a mouse cell, a lion cell, a tiger cell, a bear cell, or a buffalo cell), a bird cell (e.g., a duck cell or a goose cell), or a whale cell. In one embodiment, the cell is a human cell.

PNPLA3 gene expression may be inhibited in the cell by at least about 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 777% 78%, 79%, 80%, 81%, 82%, 83%, 84%, 85%, 86%, 87%, 88%, 89%, 90%, 91%, 92%, 93%, 94%, 95%, 96%, 97%, 98%, 99%, or about 100%.

PNPLA3 protein production may be inhibited in the cell by at least about 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 745%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or about 100%.

The in vivo methods and uses of the invention may include administering to a subject a composition containing an iRNA, where the iRNA includes a nucleotide sequence that is complementary to at least a part of an RNA transcript of the PNPLA3 gene of the mammal to be treated. When the organism to be treated is a human, the composition can be administered by any means known in the art including, but not limited to subcutaneous, intravenous, oral, intraperitoneal, or parenteral routes, including intracranial (e.g., intraventricular, intraparenchymal and intrathecal), intramuscular, transdermal, airway (aerosol), nasal, rectal, and topical (including buccal and sublingual) administration. In certain embodiments, the compositions are administered by subcutaneous or intravenous infusion or injection. In one embodiment, the compositions are administered by subcutaneous injection.

In some embodiments, the administration is via a depot injection. A depot injection may release the iRNA in a consistent way over a prolonged time period. Thus, a depot injection may reduce the frequency of dosing needed to obtain a desired effect, e.g., a desired inhibition of PNPLA3, or a therapeutic or prophylactic effect. A depot injection may also provide more consistent serum concentrations. Depot injections may include subcutaneous injections or intramuscular injections. In preferred embodiments, the depot injection is a subcutaneous injection.

In some embodiments, the administration is via a pump. The pump may be an external pump or a surgically implanted pump. In certain embodiments, the pump is a subcutaneously implanted osmotic pump. In other embodiments, the pump is an infusion pump. An infusion pump may be used for intravenous, subcutaneous, arterial, or epidural infusions. In preferred embodiments, the infusion pump is a subcutaneous infusion pump. In other embodiments, the pump is a surgically implanted pump that delivers the iRNA to the subject.

The mode of administration may be chosen based upon whether local or systemic treatment is desired and based upon the area to be treated. The route and site of administration may be chosen to enhance targeting.

In one aspect, the present invention also provides methods for inhibiting the expression of an PNPLA3 gene in a mammal, e.g., a human. The present invention also provides a composition comprising an iRNA, e.g., a dsRNA, that targets an PNPLA3 gene in a cell of a mammal for use in inhibiting expression of the PNPLA3 gene in the mammal. In another aspect, the present invention provides use of an iRNA, e.g., a dsRNA, that targets an PNPLA3 gene in a cell of a mammal in the manufacture of a medicament for inhibiting expression of the PNPLA3 gene in the mammal.

The methods and uses include administering to the mammal, e.g., a human, a composition comprising an iRNA, e.g., a dsRNA, that targets an PNPLA3 gene in a cell of the mammal and maintaining the mammal for a time sufficient to obtain degradation of the mRNA transcript of the PNPLA3 gene, thereby inhibiting expression of the PNPLA3 gene in the mammal.

Reduction in gene expression can be assessed in peripheral blood sample of the iRNA-administered subject by any methods known it the art, e.g. qRT-PCR, described herein. Reduction in protein production can be assessed by any methods known it the art and by methods, e.g., ELISA or Western blotting, described herein. In one embodiment, a tissue sample serves as the tissue material for monitoring the reduction in PNPLA3 gene and/or protein expression. In another embodiment, a blood sample serves as the tissue material for monitoring the reduction in PNPLA3 gene and/or protein expression.

In one embodiment, verification of RISC medicated cleavage of target in vivo following administration of iRNA agent is done by performing 5'-RACE or modifications of the protocol as known in the art (Lasham A et al., (2010) *Nucleic Acid Res.*, 38 (3) p-e19) (Zimmermann et al. (2006) *Nature* 441: 111-4).

This invention is further illustrated by the following examples which should not be construed as limiting. The entire contents of all references, patents and published patent applications cited throughout this application, as well as the Sequence Listing, are hereby incorporated herein by reference.

EXAMPLES

Example 1. iRNA Synthesis

Source of Reagents

Where the source of a reagent is not specifically given herein, such reagent can be obtained from any supplier of reagents for molecular biology at a quality/purity standard for application in molecular biology.

Transcripts siRNA Design

A set of iRNAs targeting human PNPLA3, "Patatin-Like Phospholipase Domain Containing 3" (RefSeq Accession No. NM_025225, GI:17196625; SEQ ID NO:1 and SEQ ID NO:2) and PNPLA3 orthologs from toxicology species (for example, GenBank Accession Nos. GI: 544461323 (REFSEQ Accession No. XM_005567051.1, cynomolgus monkey; SEQ ID NO:7 and SEQ ID NO:8); GI: 544461325 (RefSeq Accession No. XM_005567052.1, cynomolgus monkey; SEQ ID NO:11 and SEQ ID NO:12); GI:297261270 (RefSeq Accession No. XM_001109144.2, rhesus monkey, SEQ ID NO:9 and SEQ ID NO:10); GI:144226244 (RefSeq Accession No. NM_054088.3, mouse; SEQ ID NO:3 and SEQ ID NO:4); GI:537361027 (RefSeq Accession No. NM_001282324.1, rat; SEQ ID NO:5 and SEQ ID NO:6)) were designed using custom R and Python scripts.

The human PNPLA3 RefSeq mRNA has a length of 2805 bases. The rationale and method for the set of iRNA designs is as follows: the predicted efficacy for every potential 19mer iRNA from position 1 through position 2805 of human PNPLA3 mRNA (containing the coding region) was determined using a linear model that predicted the direct measure of mRNA knockdown based on the data of more than 20,000 distinct iRNA designs targeting a large number of vertebrate genes. Subsets of the PNPLA3 iRNAs were designed with perfect or near-perfect matches between human and cynomolgus monkey. A further subset was designed with perfect or near-perfect matches to mouse and rat PNPLA3 orthologs. For each strand of the iRNA, a custom Python script was used in a brute force search to measure the number and positions of mismatches between the iRNA and all potential alignments in the target species transcriptome. Extra weight was given to mismatches in the seed region, defined here as positions 2-9 of the antisense oligonucleotide, as well the cleavage site of the iRNA, defined here as positions 10-11 of the antisense oligonucleotide. The relative weights for the mismatches were 2.8 for seed mismatches, 1.2 for cleavage site mismatches, and 1 for mismatches in other positions up through antisense position 19. Mismatches in the first position were ignored. A specificity score was calculated for each strand by summing the value of each weighted mismatch. Preference was given to iRNAs whose antisense score in human and cynomolgus monkey was greater than or equal to 3.0 and predicted efficacy was greater than or equal to 70% knockdown of the PNPLA3 transcript. One set of iRNAs containing structure-activity modifications, including various 2'-O-methyl and 2'-fluoro substitution patterns, were also designed, synthesized and screened.

A detailed list of the unmodified PNPLA3 sense and antisense strand sequences is shown in Table 3.

siRNA Synthesis

PNPLA3 iRNA sequences were synthesized at 1 µmol scale on a Mermade 192 synthesizer (BioAutomation) using the solid support mediated phosphoramidite chemistry. The solid support is controlled pore glass (500 A) loaded with custom GalNAc ligand or universal solid support (AM biochemical). Ancillary synthesis reagents, 2'-F and 2'-O-Methyl RNA and deoxy phosphoramidites were obtained from Thermo-Fisher (Milwaukee, Wis.) and Hongene (China). 2'F 2'-O-Methyl, GNA (glycol nucleic acids), 5'phosphate and other modifications were introduced using the corresponding phosphoramidites. Synthesis of 3' GalNAc conjugated single strands was performed on a GalNAc modified CPG support. Custom CPG universal solid support was used for the synthesis of antisense single strands. Coupling time for all phosphoramidites (100 mM in acetonitrile) was 5 minutes employing 5-Ethylthio-1H-tetrazole (ETT) as activator (0.6 M in acetonitrile). Phosphorothioate linkages were generated using a 50 mM solution of 3-((Dimethylamino-methylidene) amino)-3H-1,2,4-dithiazole-3-thione (DDTT, obtained from Chemgenes (Wilmington, Mass., USA)) in anhydrous acetonitrile/pyridine (1:1 v/v). Oxidation time was 3 minutes. All sequences were synthesized with final removal of the DMT group ("DMT off").

Upon completion of the solid phase synthesis, oligoribonucleotides were cleaved from the solid support and deprotected in sealed 96 deep well plates using 200 µL Aqueous Methylamine reagents at 60° C. for 20 minutes. For sequences containing 2' ribo residues (2'-OH) that were protected with a tert-butyl dimethyl silyl (TBDMS) group, a second step deprotection was performed using TEA.3HF (triethylamine trihydro fluoride) reagent. To the methylamine deprotection solution, 200 uL of dimethyl sulfoxide (DMSO) and 300 ul TEA.3HF reagent were added and the solution was incubated for additional 20 minutes at 60° C. At the end of cleavage and deprotection step, the synthesis plate was allowed to come to room temperature and was precipitated by addition of 1 mL of acetontile: ethanol mixture (9:1). The plates were cooled at −80 C for 2 hours, superanatant was decanted carefully with the aid of a multi channel pipette. The oligonucleotide pellet was re-suspended in 20 mM NaOAc buffer and was desalted using a 5 mL HiTrap size exclusion column (GE Healthcare) on an AKTA Purifier System equipped with an A905 autosampler and a Frac 950 fraction collector. Desalted samples were collected in 96-well plates. Samples from each sequence were analyzed by LC-MS to confirm the identity, UV (260 nm) for quantification and a selected set of samples by IEX chromatography to determine purity.

Annealing of PNPLA3 single strands was performed on a Tecan liquid handling robot. Equimolar mixture of sense and antisense single strands were combined and annealed in 96 well plates. After combining the complementary single strands, the 96-well plate was sealed tightly and heated in an oven at 100° C. for 10 minutes and allowed to come slowly to room temperature over a period 2-3 hours. The concentration of each duplex was normalized to 10 µM in 1×PBS.

TABLE 2

Abbreviations of nucleotide monomers used in nucleic acid sequence representation. It will be understood that these monomers, when present in an oligonucleotide, are mutually linked by 5'-3'-phosphodiester bonds.

| Abbreviation | Nucleotide(s) |
| --- | --- |
| A | Adenosine-3'-phosphate |
| Af | 2'-fluoroadenosine-3'-phosphate |
| Afs | 2'-fluoroadenosine-3'-phosphorothioate |
| As | adenosine-3'-phosphorothioate |
| C | cytidine-3'-phosphate |
| Cf | 2'-fluorocytidine-3'-phosphate |
| Cfs | 2'-fluorocytidine-3'-phosphorothioate |
| Cs | cytidine-3'-phosphorothioate |
| G | guanosine-3'-phosphate |
| Gf | 2'-fluoroguanosine-3'-phosphate |
| Gfs | 2'-fluoroguanosine-3'-phosphorothioate |
| Gs | guanosine-3'-phosphorothioate |
| T | 5'-methyluridine-3'-phosphate |
| Tf | 2'-fluoro-5-methyluridine-3'-phosphate |
| Tfs | 2'-fluoro-5-methyluridine-3'-phosphorothioate |
| Ts | 5-methyluridine-3'-phosphorothioate |
| U | Uridine-3'-phosphate |
| Uf | 2'-fluorouridine-3'-phosphate |
| Ufs | 2'-fluorouridine-3'-phosphorothioate |
| Us | uridine-3'-phosphorothioate |
| N | any nucleotide (G, A, C, T or U) |
| a | 2'-O-methyladenosine-3'-phosphate |
| as | 2'-O-methyladenosine-3'-phosphorothioate |
| c | 2'-O-methylcytidine-3'-phosphate |
| cs | 2'-O-methylcytidine-3'-phosphorothioate |
| g | 2'-O-methylguanosine-3'-phosphate |
| gs | 2'-O-methylguanosine-3'-phosphorothioate |
| t | 2'-O-methyl-5-methyluridine-3'-phosphate |
| ts | 2'-O-methyl-5-methyluridine-3'-phosphorothioate |
| u | 2'-O-methyluridine-3'-phosphate |
| us | 2'-O-methyluridine-3'-phosphorothioate |
| s | phosphorothioate linkage |
| L96 | N-[tris(GalNAc-alkyl)-amidodecanoyl)]-4-hydroxyprolinol Hyp-(GalNAc-alkyl)3 |
| (dt) | 2'-deoxythymidine-3'-phosphate |
| Y34 | 2-hydroxymethyl-tetrahydrofurane-4-methoxy-3-phosphate (abasic 2'-OMe furanose) |
| Y44 | 2-hydroxymethyl-tetrahydrofurane-5-phosphate |
| (Agn) | Adenosine-glycol nucleic acid (GNA) |
| (Tgn) | Thymidine-glycol nucleic acid (GNA) S-Isomer |
| (Cgn) | Cytidine-glycol nucleic acid (GNA) |
| P | Phosphate |
| VP | Vinyl-phosphate |

TABLE 3

Unmodified Sense and Antisense Strand Sequences of PNPLA3 RNAi agents

| Oligo Name | Start Position | Sense Sequence (5'-3') | SEQ ID NO |
|---|---|---|---|
| NM_025225.2_219-240_C21A_sense | 217 | GGCUUCCUGGGCUUCUACCAA | 19 |
| NM_054088.3_250-271_sense | 248 | UAUAAUGGAGAUCCUCAUGGA | 20 |
| NM_025225.2_388-409_C21A_sense | 386 | UUGUGCGGAAGGCCAGGAGUA | 21 |
| NM_025225.2_396-417_sense | 394 | AAGGCCAGGAGUCGGAACAUU | 22 |
| NM_025225.2_397-418_G21A_senseense | 395 | AGGCCAGGAGUCGGAACAUUA | 23 |
| NM_054088.3_443-464_senseense | 441 | GUGUCUGAGUUCCAUUCCAAA | 24 |
| NM_054088.3_469-490_G21A_senseense | 467 | AGUCGUGGAUGCCCUGGUGUA | 25 |
| NM_025225.2_549-570_sense | 547 | AACGUUCUGGUGUCUGACUUU | 26 |
| NM_025225.2_562-583_G21A_sense | 560 | CUGACUUUCGGUCCAAAGACA | 27 |
| NM_025225.2_569-590_sense | 567 | UCGGUCCAAAGACGAAGUCGU | 28 |
| NM_025225.2_570-591_G21A_sense | 568 | CGGUCCAAAGACGAAGUCGUA | 29 |
| NM_025225.2_579-600_G21A_sense | 577 | GACGAAGUCGUGGAUGCCUUA | 30 |
| NM_025225.2_596-617_sense | 594 | CUUGGUAUGUUCCUGCUUCAU | 31 |
| NM_025225.2_630-651_C21A_sense | 628 | GGCCUUAUCCCUCCUUCCUUA | 32 |
| NM_025225.2_674-695_C21A_sense | 672 | AGGAGUGAGUGACAACGUACA | 33 |
| NM_025225.2_678-699_C21A_sense | 676 | GUGAGUGACAACGUACCCUUA | 34 |
| NM_025225.2_701-722_C21A_sense | 699 | UGAUGCCAAAACAACCAUCAA | 35 |
| NM_025225.2_746-767_sense | 744 | CGACAUCUGCCCUAAAGUCAA | 36 |
| NM_054088.3_770-791_C21A_sense | 768 | UGCUAUCAAGGGUACCUGGAA | 37 |
| NM_025225.2_771-792_C21A_sense | 769 | ACGAACUUUCUUCAUGUGGAA | 38 |
| NM_025225.2_817-838_C21A_sense | 815 | GCACAGGGAACCUCUACCUUA | 39 |
| NM_025225.2_871-892_C21A_sense | 869 | UGCUGGGAGAGAUAUGCCUUA | 40 |
| NM_025225.2_874-895_G21A_sense | 872 | UGGGAGAGAUAUGCCUUCGAA | 41 |
| NM_025225.2_878-899_sense | 876 | AGAGAUAUGCCUUCGAGGAUA | 42 |
| NM_025225.2_882-903_G21A_sense | 880 | AUAUGCCUUCGAGGAUAUUUA | 43 |
| NM_025225.2_885-906_sense | 883 | UGCCUUCGAGGAUAUUUGGAU | 44 |
| NM_025225.2_908-929_sense | 906 | AUUCAGGUUCUUGGAAGAGAA | 45 |
| NM_025225.2_964-985_C21A_sense | 962 | CAUCCUCAGAAGGGAUGGAUA | 46 |
| NM_025225.2_1100-1121_sense | 1098 | CCUGCCUGGGAUGAGAGCAU | 47 |
| NM_054088.3_1163-1184_G21A_sense | 1161 | UCCCAGGUUUGUGCCCGAAUA | 48 |
| NM_054088.3_1165-1186_C21A_sense | 1163 | CCAGGUUUGUGCCCGAAUGAA | 49 |
| NM_025225.2_1173-1194_C21A_sense | 1171 | GACAAAGGUGGAUACAUGAGA | 50 |
| NM_025225.2_1176-1197_G21A_sense | 1174 | AAAGGUGGAUACAUGAGCAAA | 51 |
| NM_025225.2_1180-1201_sense | 1178 | GUGGAUACAUGAGCAAGAUUU | 52 |
| NM_025225.2_1181-1202_G21A_sense | 1179 | UGGAUACAUGAGCAAGAUUUA | 53 |
| NM_025225.2_1184-1205_sense | 1182 | AUACAUGAGCAAGAUUUGCAA | 54 |
| NM_025225.2_1191-1212_sense | 1189 | AGCAAGAUUUGCAACUUGCUA | 55 |
| NM_025225.2_1193-1214_C21A_sense | 1191 | CAAGAUUUGCAACUUGCUACA | 56 |

TABLE 3-continued

Unmodified Sense and Antisense Strand Sequences of PNPLA3 RNAi agents

| | | | |
|---|---|---|---|
| NM_025225.2_1196-1217_sense | 1194 | GAUUUGCAACUUGCUACCCAU | 57 |
| NM_025225.2_1200-1221_G21A_sense | 1198 | UGCAACUUGCUACCCAUUAGA | 58 |
| NM_025225.2_1203-1224_sense | 1201 | AACUUGCUACCCAUUAGGAUA | 59 |
| NM_025225.2_1266-1287_sense | 1264 | GCCAUUGCGAUUGUCCAGAGA | 60 |
| NM_025225.2_1274-1295_C21A_sense | 1272 | GAUUGUCCAGAGACUGGUGAA | 61 |
| NM_025225.2_1288-1309_sense | 1286 | UGGUGACAUGGCUUCCAGAUA | 62 |
| NM_025225.2_1302-1323_C21A_sense | 1300 | CCAGAUAUGCCCGACGAUGUA | 63 |
| NM_025225.2_1325-1346_C21A_sense | 1323 | GUGGUUGCAGUGGGUGACCUA | 64 |
| NM_025225.2_1389-1410_C21A_sense | 1387 | AGGUCCCAAAUGCCAGUGAGA | 65 |
| NM_025225.2_1621-1642_sense | 1619 | UCACUUGAGGAGGCGAGUCUA | 66 |
| NM_025225.2_1636-1657_sense | 1634 | AGUCUAGCAGAUUCUUUCAGA | 67 |
| NM_025225.2_1646-1667_G21A_sense | 1644 | AUUCUUUCAGAGGUGCUAAAA | 68 |
| NM_025225.2_1647-1668_sense | 1645 | UUCUUUCAGAGGUGCUAAAGU | 69 |
| NM_025225.2_1658-1679_sense | 1656 | GUGCUAAAGUUUCCCAUCUUU | 70 |
| NM_025225.2_1669-1690_C21A_sense | 1667 | UCCCAUCUUUGUGCAGCUACA | 71 |
| NM_025225.2_1713-1734_C21A_sense | 1711 | CUGCCUGUGACGUGGAGGAUA | 72 |
| NM_025225.2_1718-1739_C21A_sense | 1716 | UGUGACGUGGAGGAUCCCAGA | 73 |
| NM_025225.2_1740-1761_sense | 1738 | UCUGAGCUGAGUUGGUUUUAU | 74 |
| NM_025225.2_1741-1762_G21A_sense | 1739 | CUGAGCUGAGUUGGUUUUAUA | 75 |
| NM_025225.2_1749-1770_sense | 1747 | AGUUGGUUUUAUGAAAAGCUA | 76 |
| NM_025225.2_1751-1772_G21A_sense | 1749 | UUGGUUUUAUGAAAAGCUAGA | 77 |
| NM_025225.2_1753-1774_sense | 1751 | GGUUUUAUGAAAAGCUAGGAA | 78 |
| NM_025225.2_1754-1775_G21A_sense | 1752 | GUUUUAUGAAAAGCUAGGAAA | 79 |
| NM_025225.2_1755-1776_C21A_sense | 1753 | UUUUAUGAAAAGCUAGGAAGA | 80 |
| NM_025225.2_1758-1779_C21A_sense | 1756 | UAUGAAAAGCUAGGAAGCAAA | 81 |
| NM_025225.2_1827-1848_sense | 1825 | CGUUAAUUCAGCUGGUUGGGA | 82 |
| NM_025225.2_1828-1849_sense | 1826 | GUUAAUUCAGCUGGUUGGGAA | 83 |
| NM_025225.2_1836-1857_C21A_sense | 1834 | AGCUGGUUGGGAAAUGACACA | 84 |
| NM_025225.2_1900-1921_sense | 1898 | CCUAUUAAUGGUCAGACUGUU | 85 |
| NM_025225.2_1901-1922_C21A_sense | 1899 | CUAUUAAUGGUCAGACUGUUA | 86 |
| NM_025225.2_1984-2005_G21A_sense | 1982 | GCUGGCCCAUGUGUGAUCUUA | 87 |
| NM_025225.2_1986-2007_G21A_sense | 1984 | UGGCCCAUGUGUGAUCUUGUA | 88 |
| NM_025225.2_2190-2211_sense | 2188 | CCUAACUAAAAUAAUGUUUAA | 89 |
| NM_025225.2_2243-2264_sense | 2241 | UUACCUGUUGAAUUUUGUAUU | 90 |
| NM_025225.2_2245-2266_sense | 2243 | ACCUGUUGAAUUUUGUAUUAU | 91 |
| NM_025225.2_2258-2279_G21A_sense | 2256 | UGUAUUAUGUGAAUCAGUGAA | 92 |
| NM_025225.2_2263-2284_sense | 2261 | UAUGUGAAUCAGUGAGAUGUU | 93 |
| NM_025225.2_2278-2299_sense | 2276 | GAUGUUAGUAGAAUAAGCCUU | 94 |
| NM_025225.2_2279-2300_sense | 2277 | AUGUUAGUAGAAUAAGCCUUA | 95 |

TABLE 3-continued

Unmodified Sense and Antisense Strand Sequences of PNPLA3 RNAi agents

| | | | |
|---|---|---|---|
| NM_054088.3_3032-3053_G21A_sense | 3030 | UGGAGCAACAGUGUCUAGAUA | 96 |
| NM_054088.3_3106-3127_G21A_sense | 3104 | CUUUUGGAGGCAGCUAGGAAA | 97 |
| NM_054088.3_3226-3247_sense | 3224 | AAGACAAUGAUUUGGUGUUUA | 98 |
| NM_054088.3_3228-3249_sense | 3226 | GACAAUGAUUUGGUGUUUAGA | 99 |
| NM_054088.3_3230-3251_sense | 3228 | CAAUGAUUUGGUGUUUAGAAA | 100 |
| NM_054088.3_3447-3468_sense | 3445 | UGCCAGAUAACUUAUUACUUU | 101 |
| NM_054088.3_3473-3494_sense | 3471 | ACACCUUUGGCUCUUACUAAU | 102 |
| NM_054088.3_3629-3650_sense | 3627 | CUGGCUCCAAAUCUUUGUAUA | 103 |
| NM_054088.3_3630-3651_G21A_sense | 3628 | UGGCUCCAAAUCUUUGUAUAA | 104 |
| NM_054088.3_3635-3656_C21A_sense | 3633 | CCAAAUCUUUGUAUAGUCAUA | 105 |
| NM_054088.3_3986-4007_sense | 3984 | AGAGACAAAGUGUCUAGGCUA | 106 |
| NM_054088.3_3993-4014_sense | 3991 | AAGUGUCUAGGCUACACAGAA | 107 |
| NM_054088.3_4283-4304_G21A_sense | 4281 | AGAAACUUCUGCCUUGCUUUA | 108 |
| NM_054088.3_4540-4561_C21A_sense | 4538 | GAAGGAUUGAAUGGAUACACA | 109 |
| NM_054088.3_4543-4564_sense | 4541 | GGAUUGAAUGGAUACACCAAA | 110 |

| Oligo Name | Antisense Sequence (5'-3') | SEQ ID NO Other Set | Target Site in GenBank Ref. No. |
|---|---|---|---|
| NM_025225.2_219-240_C21A_sense | UUGGUAGAAGCCCAGGAAGCCGC | 111 hcmr | 217-239 |
| NM_054088.3_250-271_sense | UCCAUGAGGAUCUCCAUUAUACG | 112 mr | 248-270 |
| NM_025225.2_388-409_C21A_sense | UACUCCUGGCCUUCCGCACAAGA | 113 hc | 386-408 |
| NM_025225.2_396-417_sense | AAUGUUCCGACUCCUGGCCUUCC | 114 hc | 394-416 |
| NM_025225.2_397-418_G21A_senseense | UAAUGUUCCGACUCCUGGCCUUC | 115 hc | 395-417 |
| NM_054088.3_443-464_senseense | UUUGGAAUGGAACUCAGACACCA | 116 mr | 441-463 |
| NM_054088.3_469-490_G21A_senseense | UACACCAGGGCAUCCACGACUUC | 117 mr | 467-489 |
| NM_025225.2_549-570_sense | AAAGUCAGACACCAGAACGUUUU | 118 hc | 547-569 |
| NM_025225.2_562-583_G21A_sense | UGUCUUUGGACCGAAAGUCAGAC | 119 hc | 560-582 |
| NM_025225.2_569-590_sense | ACGACUUCGUCUUUGGACCGAAA | 120 hc | 567-589 |
| NM_025225.2_570-591_G21A_sense | UACGACUUCGUCUUUGGACCGAA | 121 hc | 568-590 |
| NM_025225.2_579-600_G21A_sense | UAAGGCAUCCACGACUUCGUCUU | 122 hc | 577-599 |
| NM_025225.2_596-617_sense | AUGAAGCAGGAACAUACCAAGGC | 123 hcmr | 594-616 |
| NM_025225.2_630-651_C21A_sense | UAAGGAAGGAGGGAUAAGGCCAC | 124 hcmr | 628-650 |
| NM_025225.2_674-695_C21A_sense | UGUACGUUGUCACUCACUCCUCC | 125 hc | 672-694 |
| NM_025225.2_678-699_C21A_sense | UAAGGGUACGUUGUCACUCACUC | 126 hc | 676-698 |
| NM_025225.2_701-722_C21A_sense | UUGAUGGUUGUUUUGGCAUCAAU | 127 hc | 699-721 |
| NM_025225.2_746-767_sense | UUGACUUUAGGGCAGAUGUCGUA | 128 hc | 744-766 |
| NM_054088.3_770-791_C21A_sense | UUCCAGGUACCCUUGAUAGCACA | 129 mr | 768-790 |
| NM_025225.2_771-792_C21A_sense | UUCCACAUGAAGAAAGUUCGUGG | 130 hc | 769-791 |
| NM_025225.2_817-838_C21A_sense | UAAGGUAGAGGUUCCCUGUGCAG | 131 hc | 815-837 |
| NM_025225.2_871-892_C21A_sense | UAAGGCAUAUCUCUCCCAGCACC | 132 hc | 869-891 |

TABLE 3-continued

Unmodified Sense and Antisense Strand Sequences of PNPLA3 RNAi agents

| | | | |
|---|---|---|---|
| NM_025225.2_874-895_G21A_sense | UUCGAAGGCAUAUCUCUCCAGC | 133hc | 872-894 |
| NM_025225.2_878-899_sense | UAUCCUCGAAGGCAUAUCUCUCC | 134hc | 876-898 |
| NM_025225.2_882-903_G21A_sense | UAAAUAUCCUCGAAGGCAUAUCU | 135hc | 880-902 |
| NM_025225.2_885-906_sense | AUCCAAAUAUCCUCGAAGGCAUA | 136hc | 883-905 |
| NM_025225.2_908-929_sense | UUCUCUUCCAAGAACCUGAAUGC | 137hc | 906-928 |
| NM_025225.2_964-985_C21A_sense | UAUCCAUCCCUUCUGAGGAUGAC | 138hc | 962-984 |
| NM_025225.2_1100-1121_sense | AUGCUCUCAUCCCAGGGCAGGAU | 139hc | 1098-1120 |
| NM_054088.3_1163-1184_G21A_sense | UAUUCGGGCACAAACCUGGGAUG | 140mr | 1161-1183 |
| NM_054088.3_1165-1186_C21A_sense | UUCAUUCGGGCACAAACCUGGGA | 141mr | 1163-1185 |
| NM_025225.2_1173-1194_C21A_sense | UCUCAUGUAUCCACCUUUGUCUU | 142hc | 1171-1193 |
| NM_025225.2_1176-1197_G21A_sense | UUUGCUCAUGUAUCCACCUUUGU | 143hc | 1174-1196 |
| NM_025225.2_1180-1201_sense | AAAUCUUGCUCAUGUAUCCACCU | 144hc | 1178-1200 |
| NM_025225.2_1181-1202_G21A_sense | UAAAUCUUGCUCAUGUAUCCACC | 145hc | 1179-1201 |
| NM_025225.2_1184-1205_sense | UUGCAAAUCUUGCUCAUGUAUCC | 146hc | 1182-1204 |
| NM_025225.2_1191-1212_sense | UAGCAAGUUGCAAAUCUUGCUCA | 147hc | 1189-1211 |
| NM_025225.2_1193-1214_C21A_sense | UGUAGCAAGUUGCAAAUCUUGCU | 148hc | 1191-1213 |
| NM_025225.2_1196-1217_sense | AUGGGUAGCAAGUUGCAAAUCUU | 149hc | 1194-1216 |
| NM_025225.2_1200-1221_G21A_sense | UCUAAUGGGUAGCAAGUUGCAAA | 150hc | 1198-1220 |
| NM_025225.2_1203-1224_sense | UAUCCUAAUGGGUAGCAAGUUGC | 151hc | 1201-1223 |
| NM_025225.2_1266-1287_sense | UCUCUGGACAAUCGCAAUGGCAG | 152hc | 1264-1286 |
| NM_025225.2_1274-1295_C21A_sense | UUCACCAGUCUCUGGACAAUCGC | 153hc | 1272-1294 |
| NM_025225.2_1288-1309_sense | UAUCUGGAAGCCAUGUCACCAGU | 154hc | 1286-1308 |
| NM_025225.2_1302-1323_C21A_sense | UACAUCGUCGGGCAUAUCUGGAA | 155hc | 1300-1322 |
| NM_025225.2_1325-1346_C21A_sense | UAGGUCACCCACUGCAACCACAG | 156hc | 1323-1345 |
| NM_025225.2_1389-1410_C21A_sense | UCUCACUGGCAUUUGGGACCUGG | 157hc | 1387-1409 |
| NM_025225.2_1621-1642_sense | UAGACUCGCCUCCUCAAGUGACU | 158hc | 1619-1641 |
| NM_025225.2_1636-1657_sense | UCUGAAAGAAUCUGCUAGACUCG | 159hc | 1634-1656 |
| NM_025225.2_1646-1667_G21A_sense | UUUUAGCACCUCUGAAAGAAUCU | 160hc | 1644-1666 |
| NM_025225.2_1647-1668_sense | ACUUUAGCACCUCUGAAAGAAUC | 161hc | 1645-1667 |
| NM_025225.2_1658-1679_sense | AAAGAUGGGAAACUUUAGCACCU | 162hc | 1656-1678 |
| NM_025225.2_1669-1690_C21A_sense | UGUAGCUGCACAAAGAUGGGAAA | 163hc | 1667-1689 |
| NM_025225.2_1713-1734_C21A_sense | UAUCCUCCACGUCACAGGCAGGG | 164hc | 1711-1733 |
| NM_025225.2_1718-1739_C21A_sense | UCUGGGAUCCUCCACGUCACAGG | 165hc | 1716-1738 |
| NM_025225.2_1740-1761_sense | AUAAAACCAACUCAGCUCAGAGG | 166hc | 1738-1760 |
| NM_025225.2_1741-1762_G21A_sense | UAUAAAACCAACUCAGCUCAGAG | 167hc | 1739-1761 |
| NM_025225.2_1749-1770_sense | UAGCUUUUCAUAAAACCAACUCA | 168hc | 1747-1769 |
| NM_025225.2_1751-1772_G21A_sense | UCUAGCUUUUCAUAAAACCAACU | 169hc | 1749-1771 |
| NM_025225.2_1753-1774_sense | UUCCUAGCUUUUCAUAAAACCAA | 170hc | 1751-1773 |
| NM_025225.2_1754-1775_G21A_sense | UUUCCUAGCUUUUCAUAAAACCA | 171hc | 1752-1774 |

TABLE 3-continued

Unmodified Sense and Antisense Strand Sequences of PNPLA3 RNAi agents

| | | | |
|---|---|---|---|
| NM_025225.2_1755-1776_C21A_sense | UCUUCCUAGCUUUUCAUAAAACC | 172hc | 1753-1775 |
| NM_025225.2_1758-1779_C21A_sense | UUUGCUUCCUAGCUUUUCAUAAA | 173hc | 1756-1778 |
| NM_025225.2_1827-1848_sense | UCCCAACCAGCUGAAUUAACGCA | 174hc | 1825-1847 |
| NM_025225.2_1828-1849_sense | UUCCCAACCAGCUGAAUUAACGC | 175hc | 1826-1848 |
| NM_025225.2_1836-1857_C21A_sense | UGUGUCAUUUCCCAACCAGCUGA | 176hc | 1834-1856 |
| NM_025225.2_1900-1921_sense | AACAGUCUGACCAUUAAUAGGGC | 177hc | 1898-1920 |
| NM_025225.2_1901-1922_C21A_sense | UAACAGUCUGACCAUUAAUAGGG | 178hc | 1899-1921 |
| NM_025225.2_1984-2005_G21A_sense | UAAGAUCACACAUGGGCCAGCCU | 179hc | 1982-2004 |
| NM_025225.2_1986-2007_G21A_sense | UACAAGAUCACACAUGGGCCAGC | 180hc | 1984-2006 |
| NM_025225.2_2190-2211_sense | UUAAACAUUAUUUUAGUUAGGUG | 181hc | 2188-2210 |
| NM_025225.2_2243-2264_sense | AAUACAAAAUUCAACAGGUAACA | 182hc | 2241-2263 |
| NM_025225.2_2245-2266_sense | AUAAUACAAAAUUCAACAGGUAA | 183hc | 2243-2265 |
| NM_025225.2_2258-2279_G21A_sense | UUCACUGAUUCACAUAAUACAAA | 184hc | 2256-2278 |
| NM_025225.2_2263-2284_sense | AACAUCUCACUGAUUCACAUAAU | 185hc | 2261-2283 |
| NM_025225.2_2278-2299_sense | AAGGCUUAUUCUACUAACAUCUC | 186hc | 2276-2298 |
| NM_025225.2_2279-2300_sense | UAAGGCUUAUUCUACUAACAUCU | 187hc | 2277-2299 |
| NM_054088.3_3032-3053_G21A_sense | UAUCUAGACACUGUUGCUCCAGA | 188mr | 3030-3052 |
| NM_054088.3_3106-3127_G21A_sense | UUUCCUAGCUGCCUCCAAAAGUA | 189mr | 3104-3126 |
| NM_054088.3_3226-3247_sense | UAAACACCAAAUCAUUGUCUUUG | 190mr | 3224-3246 |
| NM_054088.3_3228-3249_sense | UCUAAACACCAAAUCAUUGUCUU | 191mr | 3226-3248 |
| NM_054088.3_3230-3251_sense | UUUCUAAACACCAAAUCAUUGUC | 192mr | 3228-3250 |
| NM_054088.3_3447-3468_sense | AAAGUAAUAAGUUAUCUGGCAGG | 193mr | 3445-3467 |
| NM_054088.3_3473-3494_sense | AUUAGUAAGAGCCAAAGGUGUCC | 194mr | 3471-3493 |
| NM_054088.3_3629-3650_sense | UAUACAAAGAUUUGGAGCCAGUG | 195mr | 3627-3649 |
| NM_054088.3_3630-3651_G21A_sense | UUAUACAAAGAUUUGGAGCCAGU | 196mr | 3628-3650 |
| NM_054088.3_3635-3656_C21A_sense | UAUGACUAUACAAAGAUUUGGAG | 197mr | 3633-3655 |
| NM_054088.3_3986-4007_sense | UAGCCUAGACACUUUGUCUCUAG | 198mr | 3984-4006 |
| NM_054088.3_3993-4014_sense | UUCUGUGUAGCCUAGACACUUUG | 199mr | 3991-4013 |
| NM_054088.3_4283-4304_G21A_sense | UAAAGCAAGGCAGAAGUUUCUAC | 200mr | 4281-4303 |
| NM_054088.3_4540-4561_C21A_sense | UGUGUAUCCAUUCAAUCCUUCUG | 201mr | 4538-4560 |
| NM_054088.3_4543-4564_sense | UUUGGUGUAUCCAUUCAAUCCUU | 202mr | 4541-4563 |

Example 2. iRNA Synthesis

Source of Reagents

Where the source of a reagent is not specifically given herein, such reagent can be obtained from any supplier of reagents for molecular biology at a quality/purity standard for application in molecular biology.

Transcripts siRNA Design

A set of iRNAs targeting the human PNPLA3 (human: NCBI refseqID NM_025225; NCBI GeneID: 80339), as well as toxicology-species PNPLA3 orthologs (cynomolgus monkey: XM_005567051; mouse: NM_054088; rat: XM_006242109) were designed using custom R and Python scripts. The human PNPLA3 REFSEQ mRNA has a length of 2805 bases. The rationale and method for the set of siRNA designs is as follows: the predicted efficacy for every potential 19mer iRNA from position 174 through position 2805 (the coding region and 3' UTR) was determined with a linear model derived the direct measure of mRNA knockdown from more than 20,000 distinct iRNA designs targeting a large number of vertebrate genes. Subsets of the PNPLA3 iRNAs were designed with perfect or near-perfect matches between human and cynomolgus monkey. A further subset was designed with perfect or near-perfect matches to mouse and rat PNPLA3 orthologs. A further subset was designed with perfect or near-perfect matches to human, cynomolgus monkey, mouse, and rat PNPLA3 orthologs. For each strand of the iRNA, a custom Python script was used in a brute force search to measure the number and positions of mismatches between the iRNA and all potential alignments in the target species transcriptome. Extra weight was given to mismatches in the seed region, e.g., positions 2-9 of the antisense oligonucleotide, as well the cleavage site of the siRNA, e.g., positions 10-11 of the antisense oligonucleotide. The relative weight of the mismatches was 2.8, 1.2 and 1 for seed mismatches, cleavage site and other positions up through antisense position 19, respectively. Mismatches in the first position were ignored. A specificity score was calculated for each strand by summing the value of each weighted mismatch. Preference was given to iRNAs whose antisense score in human and cynomolgus monkey was >=3.0 and predicted efficacy was >=70% knockdown of the PNPLA3 transcript.

A detailed list of the unmodified PNPLA3 sense and antisense strand sequences is shown in Table 4. A detailed list of the modified PNPLA3 sense and antisense strand sequences is shown in Table 5.

In Vitro Screening

Cell Culture and Transfections

Hep3b cells were transfected by adding 4.9 µl of Opti-MEM plus 0.1 µl of Lipofectamine RNAiMax per well (Invitrogen, Carlsbad Calif. cat #13778-150) to 5 µl of iRNA duplexes per well into a 384-well plate and incubated at room temperature for 15 minutes. Forty µl of EMEM containing ~5×10³ cells were then added to the iRNA mixture. Cells were incubated for 24 hours prior to RNA purification. Single dose experiments were performed at 20 nM final duplex concentration.

Total RNA Isolation Using DYNABEADS mRNA Isolation Kit

RNA was isolated using an automated protocol on a BioTek-EL406 platform using DYNABEADs (Invitrogen, cat#61012). Briefly, 50 µl of Lysis/Binding Buffer and 25 µl of lysis buffer containing 3 µl of magnetic beads were added to the plate with cells. Plates were incubated on an electromagnetic shaker for 10 minutes at room temperature and then magnetic beads were captured and the supernatant was removed. Bead-bound RNA was then washed 2 times with 150 µl Wash Buffer A and once with Wash Buffer B. Beads were then washed with 150 µl Elution Buffer, re-captured and supernatant removed.

cDNA Synthesis Using ABI High Capacity cDNA Reverse Transcription Kit (Applied Biosystems, Foster City, Calif., Cat #4368813)

Ten µl of a master mix containing 1 µl 10× Buffer, 0.4 µl 25× dNTPs, 1 µl 10× Random primers, 0.5 µl Reverse Transcriptase, 0.5 µl RNase inhibitor and 6.6 µl of H₂O per reaction was added to RNA isolated above. Plates were sealed, mixed, and incubated on an electromagnetic shaker for 10 minutes at room temperature, followed by 2 h 37° C.

Real Time PCR

Two µl of cDNA were added to a master mix containing 0.5 µl of GAPDH TaqMan Probe (Hs99999905), 0.5 µl PNPLA3 probe (Hs00228747_m1) and 5 µl Lightcycler 480 probe master mix (Roche Cat #04887301001) per well in a 384 well plates (Roche cat #04887301001). Real time PCR was done in a LightCycler480 Real Time PCR system (Roche). Each duplex was tested in four independent transfections.

To calculate relative fold change, real time data were analyzed using the ΔΔCt method and normalized to assays performed with cells transfected with 20 nM AD-1955, or mock transfected cells. The results from the assays are shown in Table 6.

TABLE 4

Unmodified Sense and Antisense Strand Sequences of PNPLA3 RNAi Agents

| lex Name | Sense Oligo Name | Sense Sequence (5'-3') | SEQ ID NO | Antisense Oligo Name |
|---|---|---|---|---|
| AD-68792.1 | A-138374.1 | GGGGGCGGGGCUGACGUCA | 203 | A-138375.1 |
| AD-68793.1 | A-138376.1 | ACGUCGCGCUGGGAAUGCA | 204 | A-138377.1 |
| AD-68794.1 | A-138378.1 | GGAAUGCCCUGGCCGAGAA | 205 | A-138379.1 |
| AD-68795.1 | A-138380.1 | UGGCCGAGACACUGAGGCA | 206 | A-138381.1 |
| AD-68796.1 | A-138382.1 | UGAGGCAGGGUAGAGAGCA | 207 | A-138383.1 |
| AD-68797.1 | A-138384.1 | AGAGAGCGCUUGCGGGCGA | 208 | A-138385.1 |
| AD-68798.1 | A-138386.1 | CGGGCGCCGGGCGGAGCUA | 209 | A-138387.1 |
| AD-68799.1 | A-138388.1 | GCGGAGCUGCUGCGGAUCA | 210 | A-138389.1 |
| AD-68800.1 | A-138390.1 | UGCGGAUCAGGACCCGAGA | 211 | A-138391.1 |
| AD-68801.1 | A-138392.1 | ACCCGAGCCGAUUCCCGAU | 212 | A-138393.1 |
| AD-68802.1 | A-138394.1 | UUCCCGAUCCCGACCCAGA | 213 | A-138395.1 |
| AD-68803.1 | A-138396.1 | ACCCAGAUCCUAACCCGCA | 214 | A-138397.1 |
| AD-68804.1 | A-138398.1 | UAACCCGCGCCCCCGCCCA | 215 | A-138399.1 |
| AD-68805.1 | A-138400.1 | CCGCCCCGCCGCCGCCGCA | 216 | A-138401.1 |

TABLE 4-continued

Unmodified Sense and Antisense Strand Sequences of PNPLA3 RNAi Agents

| | | | |
|---|---|---|---|
| AD-68806.1 | A-138402.1 | CGCCGCCAUGUACGACGCA | 217A-138403.1 |
| AD-68807.1 | A-138404.1 | UACGACGCAGAGCGCGGCU | 218A-138405.1 |
| AD-68808.1 | A-138406.1 | CGCGGCUGGAGCUUGUCCU | 219A-138407.1 |
| AD-68809.1 | A-138408.1 | AGCUUGUCCUUCGCGGGCU | 220A-138409.1 |
| AD-68810.1 | A-138410.1 | CGCGGGCUGCGGCUUCCUA | 221A-138411.1 |
| AD-68811.1 | A-138412.1 | UUCCUGGGCUUCUACCACA | 222A-138413.1 |
| AD-68812.1 | A-138414.1 | UUCUACCACGUCGGGGCGA | 223A-138415.1 |
| AD-68813.1 | A-138416.1 | CGGGGCGACCCGCUGCCUA | 224A-138417.1 |
| AD-68814.1 | A-138418.1 | UGCCUGAGCGAGCACGCCA | 225A-138419.1 |
| AD-68815.1 | A-138420.1 | AGCACGCCCCGCACCUCCU | 226A-138421.1 |
| AD-68816.1 | A-138422.1 | ACCUCCUCCGCGACGCGCA | 227A-138423.1 |
| AD-68817.1 | A-138424.1 | GCGACGCGCGCAUGUUGUU | 228A-138425.1 |
| AD-68818.1 | A-138426.1 | UGUUGUUCGGCGCUUCGGA | 229A-138427.1 |
| AD-68819.1 | A-138428.1 | CUUCGGCCGGGGCGUUGCA | 230A-138429.1 |
| AD-68820.1 | A-138430.1 | GGCGUUGCACUGCGUCGGA | 231A-138431.1 |
| AD-68821.1 | A-138432.1 | UGCGUCGGCGUCCUCUCCA | 232A-138433.1 |
| AD-68822.1 | A-138434.1 | UCUCCGGUAUCCCGCUGGA | 233A-138435.1 |
| AD-68823.1 | A-138436.1 | UCCCGCUGGAGCAGACUCU | 234A-138437.1 |
| AD-68824.1 | A-138438.1 | CAGACUCUGCAGGUCCUCU | 235A-138439.1 |
| AD-68825.1 | A-138440.1 | UCCUCUCAGAUCUUGUGCA | 236A-138441.1 |
| AD-68826.1 | A-138442.1 | UCUUGUGCGGAAGGCCAGA | 237A-138443.1 |
| AD-68827.1 | A-138444.1 | AAGGCCAGGAGUCGGAACA | 238A-138445.1 |
| AD-68828.1 | A-138446.1 | CGGAACAUUGGCAUCUUCA | 239A-138447.1 |
| AD-68829.1 | A-138448.1 | GCAUCUUCCAUCCAUCCUU | 240A-138449.1 |
| AD-68830.1 | A-138450.1 | CCAUCCUUCAACUUAAGCA | 241A-138451.1 |
| AD-68831.1 | A-138452.1 | UUAAGCAAGUUCCUCCGAA | 242A-138453.1 |
| AD-68832.1 | A-138454.1 | CCUCCGACAGGGUCUCUGA | 243A-138455.1 |
| AD-68833.1 | A-138456.1 | UCUCUGCAAAUGCCUCCCA | 244A-138457.1 |
| AD-68834.1 | A-138458.1 | UGCCUCCCGGCCAAUGUCA | 245A-138459.1 |
| AD-68835.1 | A-138460.1 | AAUGUCCACCAGCUCAUCU | 246A-138461.1 |
| AD-68836.1 | A-138462.1 | AGCUCAUCUCCGGCAAAAU | 247A-138463.1 |
| AD-68837.1 | A-138464.1 | CGGCAAAAUAGGCAUCUCU | 248A-138465.1 |
| AD-68838.1 | A-138466.1 | AUCUCUCUUACCAGAGUGU | 249A-138467.1 |
| AD-68839.1 | A-138468.1 | ACCAGAGUGUCUGAUGGGA | 250A-138469.1 |
| AD-68840.1 | A-138470.1 | AUGGGGAAAACGUUCUGGU | 251A-138471.1 |
| AD-68841.1 | A-138472.1 | ACGUUCUGGUGUCUGACUU | 252A-138473.1 |
| AD-68842.1 | A-138474.1 | UCUGACUUUCGGUCCAAAG | 253A-138475.1 |
| AD-68843.1 | A-138476.1 | UCCAAAGACGAAGUCGUGA | 254A-138477.1 |
| AD-68844.1 | A-138478.1 | AAGUCGUGGAUGCCUUGGU | 255A-138479.1 |

TABLE 4-continued

Unmodified Sense and Antisense Strand Sequences of PNPLA3 RNAi Agents

| | | | |
|---|---|---|---|
| AD-68845.1 | A-138480.1 | CCUUGGUAUGUUCCUGCUU | 256A-138481.1 |
| AD-68846.1 | A-138482.1 | UCCUGCUUCAUCCCCUUCU | 257A-138483.1 |
| AD-68847.1 | A-138484.1 | UCCCCUUCUACAGUGGCCU | 258A-138485.1 |
| AD-68848.1 | A-138486.1 | AGUGGCCUUAUCCCUCCUU | 259A-138487.1 |
| AD-68849.1 | A-138488.1 | CCUCCUUCCUUCAGAGGCA | 260A-138489.1 |
| AD-68850.1 | A-138490.1 | UCAGAGGCGUGCGAUAUGU | 261A-138491.1 |
| AD-68851.1 | A-138492.1 | GAUAUGUGGAUGGAGGAGU | 262A-138493.1 |
| AD-68852.1 | A-138494.1 | GAGGAGUGAGUGACAACGU | 263A-138495.1 |
| AD-68853.1 | A-138496.1 | UGACAACGUACCCUUCAUU | 264A-138497.1 |
| AD-68854.1 | A-138498.1 | CCUUCAUUGAUGCCAAAAC | 265A-138499.1 |
| AD-68855.1 | A-138500.1 | UGCCAAAACAACCAUCACA | 266A-138501.1 |
| AD-68856.1 | A-138502.1 | AUCACCGUGUCCCCCUUCU | 267A-138503.1 |
| AD-68857.1 | A-138504.1 | UCCCCCUUCUAUGGGGAGU | 268A-138505.1 |
| AD-68858.1 | A-138506.1 | UGGGGAGUACGACAUCUGA | 269A-138507.1 |
| AD-68859.1 | A-138508.1 | AUCUGCCCUAAAGUCAAGU | 270A-138509.1 |
| AD-68860.1 | A-138510.1 | AGUCAAGUCCACGAACUUU | 271A-138511.1 |
| AD-68861.1 | A-138512.1 | ACGAACUUUCUUCAUGUGA | 272A-138513.1 |
| AD-68862.1 | A-138514.1 | UUCAUGUGGACAUCACCAA | 273A-138515.1 |
| AD-68863.1 | A-138516.1 | UCACCAAGCUCAGUCUACA | 274A-138517.1 |
| AD-68864.1 | A-138518.1 | AGUCUACGCCUCUGCACAA | 275A-138519.1 |
| AD-68865.1 | A-138520.1 | CUGCACAGGGAACCUCUAA | 276A-138521.1 |
| AD-68866.1 | A-138522.1 | AACCUCUACCUUCUCUCGA | 277A-138523.1 |
| AD-68867.1 | A-138524.1 | UCUCGAGAGCUUUUGUCCA | 278A-138525.1 |
| AD-68868.1 | A-138526.1 | UUUGUCCCCCGGAUCUCA | 279A-138527.1 |
| AD-68869.1 | A-138528.1 | CCGGAUCUCAAGGUGCUGA | 280A-138529.1 |
| AD-68870.1 | A-138530.1 | UGCUGGGAGAGAUAUGCCU | 281A-138531.1 |
| AD-68871.1 | A-138532.1 | AGAUAUGCCUUCGAGGAUA | 282A-138533.1 |
| AD-68872.1 | A-138534.1 | AGGAUAUUUGGAUGCAUUA | 283A-138535.1 |
| AD-68873.1 | A-138536.1 | AUGCAUUCAGGUUCUUGGA | 284A-138537.1 |
| AD-68874.1 | A-138538.1 | UUCUUGGAAGAGAAGGGCA | 285A-138539.1 |
| AD-68875.1 | A-138540.1 | GAGAAGGGCAUCUGCAACA | 286A-138541.1 |
| AD-68876.1 | A-138542.1 | UGCAACAGGCCCCAGCCAA | 287A-138543.1 |
| AD-68877.1 | A-138544.1 | CAGCCAGGCCUGAAGUCAU | 288A-138545.1 |
| AD-68878.1 | A-138546.1 | GAAGUCAUCCUCAGAAGGA | 289A-138547.1 |
| AD-68879.1 | A-138548.1 | UCAGAAGGGAUGGAUCCUA | 290A-138549.1 |
| AD-68880.1 | A-138550.1 | UGGAUCCUGAGGUCGCCAU | 291A-138551.1 |
| AD-68881.1 | A-138552.1 | CGCCAUGCCCAGCUGGGCA | 292A-138553.1 |
| AD-68882.1 | A-138554.1 | CAGCUGGGCAAACAUGAGU | 293A-138555.1 |

TABLE 4-continued

Unmodified Sense and Antisense Strand Sequences of PNPLA3 RNAi Agents

| | | | |
|---|---|---|---|
| AD-68883.1 | A-138556.1 | CAUGAGUCUGGAUUCUUCA | 294A-138557.1 |
| AD-68884.1 | A-138558.1 | UUCUUCCCGGAGUCGGCU | 295A-138559.1 |
| AD-68885.1 | A-138560.1 | AGUCGGCUGCCUUGGCUGU | 296A-138561.1 |
| AD-68905.1 | A-138562.1 | UUGGCUGUGAGGCUGGAGA | 297A-138563.1 |
| AD-68906.1 | A-138564.1 | AGGCUGGAGGGAGAUGAGA | 298A-138565.1 |
| AD-68907.1 | A-138566.1 | AUGAGCUGCUAGACCACCU | 299A-138567.1 |
| AD-68908.1 | A-138568.1 | UAGACCACCUGCGUCUCAA | 300A-138569.1 |
| AD-68909.1 | A-138570.1 | CGUCUCAGCAUCCUGCCCU | 301A-138571.1 |
| AD-68910.1 | A-138572.1 | CCUGCCCUGGGAUGAGAGA | 302A-138573.1 |
| AD-68911.1 | A-138574.1 | AUGAGAGCAUCCUGGACAA | 303A-138575.1 |
| AD-68912.1 | A-138576.1 | UGGACACCCUCUCGCCCAA | 304A-138577.1 |
| AD-68913.1 | A-138578.1 | UCGCCCAGGCUCGCUACAA | 305A-138579.1 |
| AD-68914.1 | A-138580.1 | UCGCUACAGCACUGAGUGA | 306A-138581.1 |
| AD-68915.1 | A-138582.1 | CUGAGUGAAGAAAUGAAAG | 307A-138583.1 |
| AD-68916.1 | A-138584.1 | AUGAAAGACAAAGGUGGAU | 308A-138585.1 |
| AD-68917.1 | A-138586.1 | AAGGUGGAUACAUGAGCAA | 309A-138587.1 |
| AD-68918.1 | A-138588.1 | AUGAGCAAGAUUUGCAACU | 310A-138589.1 |
| AD-68919.1 | A-138590.1 | UUGCAACUUGCUACCCAUU | 311A-138591.1 |
| AD-68920.1 | A-138592.1 | ACCCAUUAGGAUAAUGUCU | 312A-138593.1 |
| AD-68921.1 | A-138594.1 | UAAUGUCUUAUGUAAUGCU | 313A-138595.1 |
| AD-68922.1 | A-138596.1 | UAAUGCUGCCCUGUACCCU | 314A-138597.1 |
| AD-68923.1 | A-138598.1 | UGUACCCUGCCUGUGGAAU | 315A-138599.1 |
| AD-68924.1 | A-138600.1 | UGUGGAAUCUGCCAUUGCA | 316A-138601.1 |
| AD-68925.1 | A-138602.1 | UGCCAUUGCGAUUGUCCAA | 317A-138603.1 |
| AD-68926.1 | A-138604.1 | UUGUCCAGAGACUGGUGAA | 318A-138605.1 |
| AD-68927.1 | A-138606.1 | GGUGACAUGGCUUCCAGAU | 319A-138607.1 |
| AD-68928.1 | A-138608.1 | UUCCAGAUAUGCCCGACGA | 320A-138609.1 |
| AD-68929.1 | A-138610.1 | UGCCCGACGAUGUCCUGUA | 321A-138611.1 |
| AD-68930.1 | A-138612.1 | UCCUGUGGUUGCAGUGGGU | 322A-138613.1 |
| AD-68931.1 | A-138614.1 | AGUGGGUGACCUCACAGGU | 323A-138615.1 |
| AD-68932.1 | A-138616.1 | UCACAGGUGUUCACUCGAA | 324A-138617.1 |
| AD-68933.1 | A-138618.1 | UUCACUCGAGUGCUGAUGU | 325A-138619.1 |
| AD-68934.1 | A-138620.1 | UGAUGUGCUGCUCCCCGA | 326A-138621.1 |
| AD-68935.1 | A-138622.1 | UGCUCCCCGCCUCCAGGUA | 327A-138623.1 |
| AD-68936.1 | A-138624.1 | CCAGGUCCCAAAUGCCAGU | 328A-138625.1 |
| AD-68937.1 | A-138626.1 | AAUGCCAGUGAGCAGCCAA | 329A-138627.1 |
| AD-68938.1 | A-138628.1 | AGCCAACAGGCCUCCCCAU | 330A-138629.1 |
| AD-68939.1 | A-138630.1 | CCUCCCCAUGCACACCUGA | 331A-138631.1 |
| AD-68940.1 | A-138632.1 | CACCUGAGCAGGACUGGCA | 332A-138633.1 |

TABLE 4-continued

Unmodified Sense and Antisense Strand Sequences of PNPLA3 RNAi Agents

| | | | | |
|---|---|---|---|---|
| AD-68941.1 | A-138634.1 | GACUGGCCCUGCUGGACUA | 333 | A-138635.1 |
| AD-68942.1 | A-138636.1 | UGCUGGACUCCCUGCUCCA | 334 | A-138637.1 |
| AD-68943.1 | A-138638.1 | CUGCUCCCCAAGGGCUGU | 335 | A-138639.1 |
| AD-68944.1 | A-138640.1 | AGGGCUGUCCAGCAGAGAA | 336 | A-138641.1 |
| AD-68945.1 | A-138642.1 | CAGAGACCAAAGCAGAGGA | 337 | A-138643.1 |
| AD-68946.1 | A-138644.1 | AGCAGAGGCCACCCCGCGA | 338 | A-138645.1 |
| AD-68947.1 | A-138646.1 | CCGCGGUCCAUCCUCAGGU | 339 | A-138647.1 |
| AD-68948.1 | A-138648.1 | CCUCAGGUCCAGCCUGAAA | 340 | A-138649.1 |
| AD-68949.1 | A-138650.1 | AGCCUGAACUUCUUCUUGA | 341 | A-138651.1 |
| AD-68950.1 | A-138652.1 | UUCUUGGGCAAUAAAGUAA | 342 | A-138653.1 |
| AD-68951.1 | A-138654.1 | UAAAGUACCUGCUGGUGCU | 343 | A-138655.1 |
| AD-68952.1 | A-138656.1 | CUGGUGCUGAGGGGCUCUA | 344 | A-138657.1 |
| AD-68953.1 | A-138658.1 | AGGGGCUCUCCACCUUUCA | 345 | A-138659.1 |
| AD-68954.1 | A-138660.1 | CCUUUCCCAGUUUUUCACU | 346 | A-138661.1 |
| AD-68955.1 | A-138662.1 | UUUUUCACUAGAGAAGAGU | 347 | A-138663.1 |
| AD-68956.1 | A-138664.1 | AAGAGUCUGUGAGUCACUU | 348 | A-138665.1 |
| AD-68957.1 | A-138666.1 | AGUCACUUGAGGAGGCGAA | 349 | A-138667.1 |
| AD-68958.1 | A-138668.1 | AGGAGGCGAGUCUAGCAGA | 350 | A-138669.1 |
| AD-68959.1 | A-138670.1 | AGCAGAUUCUUUCAGAGGU | 351 | A-138671.1 |
| AD-68960.1 | A-138672.1 | UUCAGAGGUGCUAAAGUUU | 352 | A-138673.1 |
| AD-68961.1 | A-138674.1 | UAAAGUUUCCCAUCUUUGU | 353 | A-138675.1 |
| AD-68962.1 | A-138676.1 | UCUUUGUGCAGCUACCUCA | 354 | A-138677.1 |
| AD-68963.1 | A-138678.1 | AGCUACCUCCGCAUUGCUA | 355 | A-138679.1 |
| AD-68964.1 | A-138680.1 | UUGCUGUGUAGUGACCCCU | 356 | A-138681.1 |
| AD-68965.1 | A-138682.1 | UGACCCCUGCCUGUGACGU | 357 | A-138683.1 |
| AD-68966.1 | A-138684.1 | UGUGACGUGGAGGAUCCCA | 358 | A-138685.1 |
| AD-68967.1 | A-138686.1 | AGGAUCCCAGCCUCUGAGA | 359 | A-138687.1 |
| AD-68968.1 | A-138688.1 | CUCUGAGCUGAGUUGGUUU | 360 | A-138689.1 |
| AD-68969.1 | A-138690.1 | UUGGUUUUAUGAAAAGCUA | 361 | A-138691.1 |
| AD-68970.1 | A-138692.1 | AAAAGCUAGGAAGCAACCU | 362 | A-138693.1 |
| AD-68971.1 | A-138694.1 | GAAGCAACCUUUCGCCUGU | 363 | A-138695.1 |
| AD-68972.1 | A-138696.1 | UCGCCUGUGCAGCGGUCCA | 364 | A-138697.1 |
| AD-68973.1 | A-138698.1 | CGGUCCAGCACUUAACUCU | 365 | A-138699.1 |
| AD-68974.1 | A-138700.1 | UUAACUCUAAUACAUCAGA | 366 | A-138701.1 |
| AD-68975.1 | A-138702.1 | UACAUCAGCAUGCGUUAAU | 367 | A-138703.1 |
| AD-68976.1 | A-138704.1 | CGUUAAUUCAGCUGGUUGA | 368 | A-138705.1 |
| AD-68977.1 | A-138706.1 | CUGGUUGGGAAAUGACACA | 369 | A-138707.1 |
| AD-68978.1 | A-138708.1 | AAUGACACCAGGAAGCCCA | 370 | A-138709.1 |

TABLE 4-continued

Unmodified Sense and Antisense Strand Sequences of PNPLA3 RNAi Agents

| | | | |
|---|---|---|---|
| AD-68979.1 | A-138710.1 | AAGCCCAGUGCAGAGGGUA | 371A-138711.1 |
| AD-68980.1 | A-138712.1 | AGAGGGUCCCUUACUGACU | 372A-138713.1 |
| AD-68981.1 | A-138714.1 | UUACUGACUGUUUCGUGGA | 373A-138715.1 |
| AD-68982.1 | A-138716.1 | UUCGUGGCCCUAUUAAUGA | 374A-138717.1 |
| AD-68983.1 | A-138718.1 | UUAAUGGUCAGACUGUUCA | 375A-138719.1 |
| AD-68984.1 | A-138720.1 | GACUGUUCCAGCAUGAGGU | 376A-138721.1 |
| AD-68985.1 | A-138722.1 | UGAGGUUCUUAGAAUGACA | 377A-138723.1 |
| AD-68986.1 | A-138724.1 | UAGAAUGACAGGUGUUUGA | 378A-138725.1 |
| AD-68987.1 | A-138726.1 | UGUUUGGAUGGGUGGGGGA | 379A-138727.1 |
| AD-68988.1 | A-138728.1 | UGGGGGCCUUGUGAUGGGA | 380A-138729.1 |
| AD-68989.1 | A-138730.1 | UGUGAUGGGGGUAGGCUA | 381A-138731.1 |
| AD-68990.1 | A-138732.1 | UAGGCUGGCCCAUGUGUGA | 382A-138733.1 |
| AD-68991.1 | A-138734.1 | UGUGUGAUCUUGUGGGGUA | 383A-138735.1 |
| AD-68992.1 | A-138736.1 | UUGUGGGGUGGAGGGAAGA | 384A-138737.1 |
| AD-68993.1 | A-138738.1 | AGGGAAGAGAAUAGCAUGA | 385A-138739.1 |
| AD-68994.1 | A-138740.1 | UAGCAUGAUCCCACUUCCA | 386A-138741.1 |
| AD-68995.1 | A-138742.1 | ACUUCCCCAUGCUGUGGGA | 387A-138743.1 |
| AD-68996.1 | A-138744.1 | CUGUGGGAAGGGGUGCAGU | 388A-138745.1 |
| AD-68997.1 | A-138746.1 | GUGCAGUUCGUCCCCAAGA | 389A-138747.1 |
| AD-68998.1 | A-138748.1 | UCCCCAAGAACGACACUGA | 390A-138749.1 |
| AD-69014.1 | A-138750.1 | ACACUGCCUGUCAGGUGGU | 391A-138751.1 |
| AD-69015.1 | A-138752.1 | UCAGGUGGUCUGCAAAGAU | 392A-138753.1 |
| AD-69016.1 | A-138754.1 | UGCAAAGAUGAUAACCUUA | 393A-138755.1 |
| AD-69017.1 | A-138756.1 | AACCUUGACUACUAAAAAC | 394A-138757.1 |
| AD-69018.1 | A-138758.1 | UAAAAACGUCUCCAUGGCA | 395A-138759.1 |
| AD-69019.1 | A-138760.1 | CCAUGGCGGGGUAACAAA | 396A-138761.1 |
| AD-69020.1 | A-138762.1 | GGUAACAAGAUGAUAAUCU | 397A-138763.1 |
| AD-69021.1 | A-138764.1 | UGAUAAUCUACUUAAUUUU | 398A-138765.1 |
| AD-69022.1 | A-138766.1 | UUAAUUUUAGAACACCUUU | 399A-138767.1 |
| AD-69023.1 | A-138768.1 | ACACCUUUUCACCUAACU | 400A-138769.1 |
| AD-69024.1 | A-138770.1 | CCUAACUAAAAUAAUGUUU | 401A-138771.1 |
| AD-69025.1 | A-138772.1 | AUAAUGUUUAAAGAGUUUU | 402A-138773.1 |
| AD-69026.1 | A-138774.1 | GAGUUUUGUAUAAAAAUGU | 403A-138775.1 |
| AD-69027.1 | A-138776.1 | AAAAAUGUAAGGAAGCGUU | 404A-138777.1 |
| AD-69028.1 | A-138778.1 | GGAAGCGUUGUUACCUGUU | 405A-138779.1 |
| AD-69029.1 | A-138780.1 | UACCUGUUGAAUUUUGUAU | 406A-138781.1 |
| AD-69030.1 | A-138782.1 | UUGUAUUAUGUGAAUCAGU | 407A-138783.1 |
| AD-69031.1 | A-138784.1 | GAAUCAGUGAGAUGUUAGU | 408A-138785.1 |
| AD-69032.1 | A-138786.1 | AUGUUAGUAGAAUAAGCCU | 409A-138787.1 |

TABLE 4-continued

Unmodified Sense and Antisense Strand Sequences of PNPLA3 RNAi Agents

| | | | | |
|---|---|---|---|---|
| AD-69033.1 | A-138788.1 | AUAAGCCUUAAAAAAAAA | 410 | A-138789.1 |
| AD-69034.1 | A-138790.1 | AAAAAAAAAAAAUCGGUU | 411 | A-138791.1 |
| AD-69035.1 | A-138792.1 | AAUCGGUUGGGUGCAGUGA | 412 | A-138793.1 |
| AD-69036.1 | A-138794.1 | UGCAGUGGCACACGGCUGU | 413 | A-138795.1 |
| AD-69037.1 | A-138796.1 | GGCUGUAAUCCCAGCACUU | 414 | A-138797.1 |
| AD-69038.1 | A-138798.1 | CAGCACUUUGGGAGGCCAA | 415 | A-138799.1 |
| AD-69039.1 | A-138800.1 | GAGGCCAAGGUUGGCAGAU | 416 | A-138801.1 |
| AD-69040.1 | A-138802.1 | UUGGCAGAUCACCUGAGGU | 417 | A-138803.1 |
| AD-69041.1 | A-138804.1 | CUGAGGUCAGGAGUUCAAA | 418 | A-138805.1 |
| AD-69042.1 | A-138806.1 | GAGUUCAAGACCAGUCUGA | 419 | A-138807.1 |
| AD-69043.1 | A-138808.1 | CAGUCUGGCCAACAUAGCA | 420 | A-138809.1 |
| AD-69044.1 | A-138810.1 | AACAUAGCAAAACCCUGUA | 421 | A-138811.1 |
| AD-69045.1 | A-138812.1 | CCCUGUCUCUACUAAAAAU | 422 | A-138813.1 |
| AD-69046.1 | A-138814.1 | CUAAAAAUACAAAAAUUAU | 423 | A-138815.1 |
| AD-69047.1 | A-138816.1 | AAAAUUAUCUGGGCAUGGU | 424 | A-138817.1 |
| AD-69048.1 | A-138818.1 | GGCAUGGUGGUGCAUGCCU | 425 | A-138819.1 |
| AD-69049.1 | A-138820.1 | CAUGCCUGUAAUCCCAGCU | 426 | A-138821.1 |
| AD-69050.1 | A-138822.1 | AAUCCCAGCUAUUCGGAAA | 427 | A-138823.1 |
| AD-69051.1 | A-138824.1 | UUCGGAAGGCUGAGGCAGA | 428 | A-138825.1 |
| AD-69052.1 | A-138826.1 | AGGCAGGAGAAUCACUUGA | 429 | A-138827.1 |
| AD-69053.1 | A-138828.1 | AUCACUUGAACCCAGGAGA | 430 | A-138829.1 |
| AD-69054.1 | A-138830.1 | CAGGAGGCGGAGGUUGCGA | 431 | A-138831.1 |
| AD-69055.1 | A-138832.1 | GUUGCGGUGAGCUGAGAUU | 432 | A-138833.1 |
| AD-69056.1 | A-138834.1 | CUGAGAUUGCACCAUUUCA | 433 | A-138835.1 |
| AD-69057.1 | A-138836.1 | CACCAUUUCAUUCCAGCCU | 434 | A-138837.1 |
| AD-69058.1 | A-138838.1 | CAGCCUGGGCAACAUGAGU | 435 | A-138839.1 |
| AD-69059.1 | A-138840.1 | AACAUGAGUGAAAGUCUGA | 436 | A-138841.1 |
| AD-69060.1 | A-138842.1 | AGUCUGACUCAAAAAAAAA | 437 | A-138843.1 |
| AD-69061.1 | A-138844.1 | AAAAAAAAAAAUUUAAAA | 438 | A-138845.1 |
| AD-69062.1 | A-138846.1 | UUUAAAAACAAAAUAAUA | 439 | A-138847.1 |
| AD-69063.1 | A-138848.1 | AAAAUAAUCUAGUGUGCAA | 440 | A-138849.1 |
| AD-69064.1 | A-138850.1 | GUGUGCAGGGCAUUCACCU | 441 | A-138851.1 |
| AD-69065.1 | A-138852.1 | CAUUCACCUCAGCCCCCCA | 442 | A-138853.1 |
| AD-69066.1 | A-138854.1 | CCCCCAGGCAGGAGCCAAA | 443 | A-138855.1 |
| AD-69067.1 | A-138856.1 | AGGAGCCAAGCACAGCAGA | 444 | A-138857.1 |
| AD-69068.1 | A-138858.1 | ACAGCAGGAGCUUCCGCCU | 445 | A-138859.1 |
| AD-69069.1 | A-138860.1 | UUCCGCCUCCUCUCCACUA | 446 | A-138861.1 |
| AD-69070.1 | A-138862.1 | UCCACUGGAGCACACAACU | 447 | A-138863.1 |

TABLE 4-continued

Unmodified Sense and Antisense Strand Sequences of PNPLA3 RNAi Agents

| | | | |
|---|---|---|---|
| AD-69071.1 | A-138864.1 | ACACAACUUGAACCUGGCU | 448A-138865.1 |
| AD-69072.1 | A-138866.1 | AACCUGGCUUAUUUUCUGA | 449A-138867.1 |
| AD-69073.1 | A-138868.1 | UUCUGCAGGGACCAGCCCA | 450A-138869.1 |
| AD-69074.1 | A-138870.1 | CCAGCCCCACAUGGUCAGU | 451A-138871.1 |
| AD-69076.1 | A-138874.1 | UUUCUCCCAUGUGUGGCA | 452A-138875.1 |
| AD-69077.1 | A-138878.1 | AGAGAGUGUAGAAAUAAAG | 453A-138879.1 |

| lex Name | Antisense Sequence (5'-3') | SEQ ID NO | Start Site in NM_025225.2 | Nucleotide Range in NM_025225.2 |
|---|---|---|---|---|
| AD-68792.1 | UGACGUCAGCCCCGCCCCC | 454 | 11 | 11-29 |
| AD-68793.1 | UGCAUUCCCAGCGCGACGU | 455 | 24 | 24-42 |
| AD-68794.1 | UUCUCGGCCAGGGCAUUCC | 456 | 35 | 35-53 |
| AD-68795.1 | UGCCUCAGUGUCUCGGCCA | 457 | 44 | 44-62 |
| AD-68796.1 | UGCUCUCUACCCUGCCUCA | 458 | 56 | 56-74 |
| AD-68797.1 | UCGCCCGCAAGCGCUCUCU | 459 | 67 | 67-85 |
| AD-68798.1 | UAGCUCCGCCCGGCGCCCG | 460 | 79 | 79-97 |
| AD-68799.1 | UGAUCCGCAGCAGCUCCGC | 461 | 89 | 89-107 |
| AD-68800.1 | UCUCGGGUCCUGAUCCGCA | 462 | 99 | 99-117 |
| AD-68801.1 | AUCGGGAAUCGGCUCGGGU | 463 | 110 | 110-128 |
| AD-68802.1 | UCUGGGUCGGGAUCGGGAA | 464 | 121 | 121-139 |
| AD-68803.1 | UGCGGGUUAGGAUCUGGGU | 465 | 133 | 133-151 |
| AD-68804.1 | UGGGCGGGGGCGCGGGUUA | 466 | 143 | 143-161 |
| AD-68805.1 | UGCGGCGGCGGCGGGGCGG | 467 | 155 | 155-173 |
| AD-68806.1 | UGCGUCGUACAUGGCGGCG | 468 | 167 | 167-185 |
| AD-68807.1 | AGCCGCGCUCUGCGUCGUA | 469 | 177 | 177-195 |
| AD-68808.1 | AGGACAAGCUCCAGCCGCG | 470 | 189 | 189-207 |
| AD-68809.1 | AGCCCGCGAAGGACAAGCU | 471 | 198 | 198-216 |
| AD-68810.1 | UAGGAAGCCGCAGCCCGCG | 472 | 209 | 209-227 |
| AD-68811.1 | UGUGGUAGAAGCCCAGGAA | 473 | 222 | 222-240 |
| AD-68812.1 | UCGCCCCGACGUGGUAGAA | 474 | 231 | 231-249 |
| AD-68813.1 | UAGGCAGCGGGUCGCCCCG | 475 | 242 | 242-260 |
| AD-68814.1 | UGGCGUGCUCGCUCAGGCA | 476 | 255 | 255-273 |
| AD-68815.1 | AGGAGGUGCGGGGCGUGCU | 477 | 265 | 265-283 |
| AD-68816.1 | UGCGCGUCGCGGAGGAGGU | 478 | 277 | 277-295 |
| AD-68817.1 | AACAACAUGCGCGCGUCGC | 479 | 286 | 286-304 |
| AD-68818.1 | UCCGAAGCGCCGAACAACA | 480 | 298 | 298-316 |
| AD-68819.1 | UGCAACGCCCCGGCCGAAG | 481 | 310 | 310-328 |
| AD-68820.1 | UCCGACGCAGUGCAACGCC | 482 | 320 | 320-338 |
| AD-68821.1 | UGGAGAGGACGCCGACGCA | 483 | 330 | 330-348 |
| AD-68822.1 | UCCAGCGGGAUACCGGAGA | 484 | 343 | 343-361 |

TABLE 4-continued

Unmodified Sense and Antisense Strand Sequences of PNPLA3 RNAi Agents

| | | | | |
|---|---|---|---|---|
| AD-68823.1 | AGAGUCUGCUCCAGCGGGA | 485 | 352 | 352-370 |
| AD-68824.1 | AGAGGACCUGCAGAGUCUG | 486 | 363 | 363-381 |
| AD-68825.1 | UGCACAAGAUCUGAGAGGA | 487 | 376 | 376-394 |
| AD-68826.1 | UCUGGCCUUCCGCACAAGA | 488 | 386 | 386-404 |
| AD-68827.1 | UGUUCCGACUCCUGGCCUU | 489 | 396 | 396-414 |
| AD-68828.1 | UGAAGAUGCCAAUGUUCCG | 490 | 408 | 408-426 |
| AD-68829.1 | AAGGAUGGAUGGAAGAUGC | 491 | 418 | 418-436 |
| AD-68830.1 | UGCUUAAGUUGAAGGAUGG | 492 | 429 | 429-447 |
| AD-68831.1 | UUCGGAGGAACUUGCUUAA | 493 | 441 | 441-459 |
| AD-68832.1 | UCAGAGACCCUGUCGGAGG | 494 | 452 | 452-470 |
| AD-68833.1 | UGGGAGGCAUUUGCAGAGA | 495 | 464 | 464-482 |
| AD-68834.1 | UGACAUUGGCCGGGAGGCA | 496 | 474 | 474-492 |
| AD-68835.1 | AGAUGAGCUGGUGGACAUU | 497 | 486 | 486-504 |
| AD-68836.1 | AUUUUGCCGGAGAUGAGCU | 498 | 496 | 496-514 |
| AD-68837.1 | AGAGAUGCCUAUUUUGCCG | 499 | 506 | 506-524 |
| AD-68838.1 | ACACUCUGGUAAGAGAGAU | 500 | 519 | 519-537 |
| AD-68839.1 | UCCCAUCAGACACUCUGGU | 501 | 528 | 528-546 |
| AD-68840.1 | ACCAGAACGUUUUCCCCAU | 502 | 541 | 541-559 |
| AD-68841.1 | AAGUCAGACACCAGAACGU | 503 | 550 | 550-568 |
| AD-68842.1 | CUUUGGACCGAAAGUCAGA | 504 | 561 | 561-579 |
| AD-68843.1 | UCACGACUUCGUCUUUGGA | 505 | 573 | 573-591 |
| AD-68844.1 | ACCAAGGCAUCCACGACUU | 506 | 583 | 583-601 |
| AD-68845.1 | AAGCAGGAACAUACCAAGG | 507 | 595 | 595-613 |
| AD-68846.1 | AGAAGGGGAUGAAGCAGGA | 508 | 606 | 606-624 |
| AD-68847.1 | AGGCCACUGUAGAAGGGGA | 509 | 616 | 616-634 |
| AD-68848.1 | AAGGAGGGAUAAGGCCACU | 510 | 627 | 627-645 |
| AD-68849.1 | UGCCUCUGAAGGAAGGAGG | 511 | 639 | 639-657 |
| AD-68850.1 | ACAUAUCGCACGCCUCUGA | 512 | 649 | 649-667 |
| AD-68851.1 | ACUCCUCCAUCCACAUAUC | 513 | 661 | 661-679 |
| AD-68852.1 | ACGUUGUCACUCACUCCUC | 514 | 673 | 673-691 |
| AD-68853.1 | AAUGAAGGGUACGUUGUCA | 515 | 683 | 683-701 |
| AD-68854.1 | GUUUUGGCAUCAAUGAAGG | 516 | 694 | 694-712 |
| AD-68855.1 | UGUGAUGGUUGUUUUGGCA | 517 | 704 | 704-722 |
| AD-68856.1 | AGAAGGGGACACGGUGAU | 518 | 717 | 717-735 |
| AD-68857.1 | ACUCCCCAUAGAAGGGGA | 519 | 726 | 726-744 |
| AD-68858.1 | UCAGAUGUCGUACUCCCCA | 520 | 737 | 737-755 |
| AD-68859.1 | ACUUGACUUUAGGGCAGAU | 521 | 750 | 750-768 |
| AD-68860.1 | AAAGUUCGUGGACUUGACU | 522 | 761 | 761-779 |

TABLE 4-continued

Unmodified Sense and Antisense Strand Sequences of PNPLA3 RNAi Agents

| | | | | |
|---|---|---|---|---|
| AD-68861.1 | UCACAUGAAGAAAGUUCGU | 523 | 771 | 771-789 |
| AD-68862.1 | UUGGUGAUGUCCACAUGAA | 524 | 781 | 781-799 |
| AD-68863.1 | UGUAGACUGAGCUUGGUGA | 525 | 793 | 793-811 |
| AD-68864.1 | UUGUGCAGAGGCGUAGACU | 526 | 804 | 804-822 |
| AD-68865.1 | UUAGAGGUUCCCUGUGCAG | 527 | 815 | 815-833 |
| AD-68866.1 | UCGAGAGAAGGUAGAGGUU | 528 | 825 | 825-843 |
| AD-68867.1 | UGGACAAAAGCUCUCGAGA | 529 | 838 | 838-856 |
| AD-68868.1 | UGAGAUCCGGGGGACAAA | 530 | 849 | 849-867 |
| AD-68869.1 | UCAGCACCUUGAGAUCCGG | 531 | 858 | 858-876 |
| AD-68870.1 | AGGCAUAUCUCUCCCAGCA | 532 | 871 | 871-889 |
| AD-68871.1 | UAUCCUCGAAGGCAUAUCU | 533 | 880 | 880-898 |
| AD-68872.1 | UAAUGCAUCCAAAUAUCCU | 534 | 893 | 893-911 |
| AD-68873.1 | UCCAAGAACCUGAAUGCAU | 535 | 904 | 904-922 |
| AD-68874.1 | UGCCCUUCUCUUCCAAGAA | 536 | 915 | 915-933 |
| AD-68875.1 | UGUUGCAGAUGCCCUUCUC | 537 | 924 | 924-942 |
| AD-68876.1 | UUGGCUGGGCCUGUUGCA | 538 | 936 | 936-954 |
| AD-68877.1 | AUGACUUCAGGCCUGGCUG | 539 | 948 | 948-966 |
| AD-68878.1 | UCCUUCUGAGGAUGACUUC | 540 | 959 | 959-977 |
| AD-68879.1 | UAGGAUCCAUCCCUUCUGA | 541 | 969 | 969-987 |
| AD-68880.1 | AUGGCGACCUCAGGAUCCA | 542 | 979 | 979-997 |
| AD-68881.1 | UGCCCAGCUGGGCAUGGCG | 543 | 992 | 992-1010 |
| AD-68882.1 | ACUCAUGUUUGCCCAGCUG | 544 | 1001 | 1001-1019 |
| AD-68883.1 | UGAAGAAUCCAGACUCAUG | 545 | 1013 | 1013-1031 |
| AD-68884.1 | AGCCGACUCCGGGGAAGAA | 546 | 1025 | 1025-1043 |
| AD-68885.1 | ACAGCCAAGGCAGCCGACU | 547 | 1036 | 1036-1054 |
| AD-68905.1 | UCUCCAGCCUCACAGCCAA | 548 | 1047 | 1047-1065 |
| AD-68906.1 | UCUCAUCUCCCUCCAGCCU | 549 | 1056 | 1056-1074 |
| AD-68907.1 | AGGUGGUCUAGCAGCUCAU | 550 | 1069 | 1069-1087 |
| AD-68908.1 | UUGAGACGCAGGUGGUCUA | 551 | 1078 | 1078-1096 |
| AD-68909.1 | AGGGCAGGAUGCUGAGACG | 552 | 1089 | 1089-1107 |
| AD-68910.1 | UCUCUCAUCCCAGGGCAGG | 553 | 1100 | 1100-1118 |
| AD-68911.1 | UUGUCCAGGAUGCUCUCAU | 554 | 1111 | 1111-1129 |
| AD-68912.1 | UUGGGCGAGAGGGUGUCCA | 555 | 1123 | 1123-1141 |
| AD-68913.1 | UUGUAGCGAGCCUGGGCGA | 556 | 1134 | 1134-1152 |
| AD-68914.1 | UCACUCAGUGCUGUAGCGA | 557 | 1144 | 1144-1162 |
| AD-68915.1 | CUUUCAUUUCUUCACUCAG | 558 | 1155 | 1155-1173 |
| AD-68916.1 | AUCCACCUUUGUCUUUCAU | 559 | 1167 | 1167-1185 |
| AD-68917.1 | UUGCUCAUGUAUCCACCUU | 560 | 1177 | 1177-1195 |
| AD-68918.1 | AGUUGCAAAUCUUGCUCAU | 561 | 1188 | 1188-1206 |

TABLE 4-continued

Unmodified Sense and Antisense Strand Sequences of PNPLA3 RNAi Agents

| | | | | |
|---|---|---|---|---|
| AD-68919.1 | AAUGGGUAGCAAGUUGCAA | 562 | 1199 | 1199-1217 |
| AD-68920.1 | AGACAUUAUCCUAAUGGGU | 563 | 1211 | 1211-1229 |
| AD-68921.1 | AGCAUUACAUAAGACAUUA | 564 | 1222 | 1222-1240 |
| AD-68922.1 | AGGGUACAGGGCAGCAUUA | 565 | 1234 | 1234-1252 |
| AD-68923.1 | AUUCCACAGGCAGGGUACA | 566 | 1245 | 1245-1263 |
| AD-68924.1 | UGCAAUGGCAGAUUCCACA | 567 | 1256 | 1256-1274 |
| AD-68925.1 | UUGGACAAUCGCAAUGGCA | 568 | 1265 | 1265-1283 |
| AD-68926.1 | UUCACCAGUCUCUGGACAA | 569 | 1276 | 1276-1294 |
| AD-68927.1 | AUCUGGAAGCCAUGUCACC | 570 | 1289 | 1289-1307 |
| AD-68928.1 | UCGUCGGGCAUAUCUGGAA | 571 | 1300 | 1300-1318 |
| AD-68929.1 | UACAGGACAUCGUCGGGCA | 572 | 1309 | 1309-1327 |
| AD-68930.1 | ACCCACUGCAACCACAGGA | 573 | 1321 | 1321-1339 |
| AD-68931.1 | ACCUGUGAGGUCACCCACU | 574 | 1333 | 1333-1351 |
| AD-68932.1 | UUCGAGUGAACACCUGUGA | 575 | 1344 | 1344-1362 |
| AD-68933.1 | ACAUCAGCACUCGAGUGAA | 576 | 1353 | 1353-1371 |
| AD-68934.1 | UCGGGAGCAGACACAUCA | 577 | 1366 | 1366-1384 |
| AD-68935.1 | UACCUGGAGGCGGGGAGCA | 578 | 1375 | 1375-1393 |
| AD-68936.1 | ACUGGCAUUUGGGACCUGG | 579 | 1387 | 1387-1405 |
| AD-68937.1 | UUGGCUGCUCACUGGCAUU | 580 | 1397 | 1397-1415 |
| AD-68938.1 | AUGGGAGGCCUGUUGGCU | 581 | 1410 | 1410-1428 |
| AD-68939.1 | UCAGGUGUGCAUGGGGAGG | 582 | 1420 | 1420-1438 |
| AD-68940.1 | UGCCAGUCCUGCUCAGGUG | 583 | 1432 | 1432-1450 |
| AD-68941.1 | UAGUCCAGCAGGGCCAGUC | 584 | 1443 | 1443-1461 |
| AD-68942.1 | UGGAGCAGGGAGUCCAGCA | 585 | 1452 | 1452-1470 |
| AD-68943.1 | ACAGCCCUUGGGGGAGCAG | 586 | 1463 | 1463-1481 |
| AD-68944.1 | UUCUCUGCUGGACAGCCCU | 587 | 1474 | 1474-1492 |
| AD-68945.1 | UCCUCUGCUUUGGUCUCUG | 588 | 1486 | 1486-1504 |
| AD-68946.1 | UCGCGGGGUGGCCUCUGCU | 589 | 1496 | 1496-1514 |
| AD-68947.1 | ACCUGAGGAUGGACCGCGG | 590 | 1509 | 1509-1527 |
| AD-68948.1 | UUUCAGGCUGGACCUGAGG | 591 | 1520 | 1520-1538 |
| AD-68949.1 | UCAAGAAGAAGUUCAGGCU | 592 | 1530 | 1530-1548 |
| AD-68950.1 | UUACUUUAUUGCCCAAGAA | 593 | 1542 | 1542-1560 |
| AD-68951.1 | AGCACCAGCAGGUACUUUA | 594 | 1553 | 1553-1571 |
| AD-68952.1 | UAGAGCCCUCAGCACCAG | 595 | 1564 | 1564-1582 |
| AD-68953.1 | UGAAAGGUGGAGAGCCCCU | 596 | 1573 | 1573-1591 |
| AD-68954.1 | AGUGAAAACUGGGAAAGG | 597 | 1585 | 1585-1603 |
| AD-68955.1 | ACUCUUCUCUAGUGAAAAA | 598 | 1595 | 1595-1613 |
| AD-68956.1 | AAGUGACUCACAGACUCUU | 599 | 1608 | 1608-1626 |

TABLE 4-continued

Unmodified Sense and Antisense Strand Sequences of PNPLA3 RNAi Agents

| | | | | |
|---|---|---|---|---|
| AD-68957.1 | UUCGCCUCCUCAAGUGACU | 600 | 1619 | 1619-1637 |
| AD-68958.1 | UCUGCUAGACUCGCCUCCU | 601 | 1628 | 1628-1646 |
| AD-68959.1 | ACCUCUGAAAGAAUCUGCU | 602 | 1641 | 1641-1659 |
| AD-68960.1 | AAACUUUAGCACCUCUGAA | 603 | 1651 | 1651-1669 |
| AD-68961.1 | ACAAAGAUGGGAAACUUUA | 604 | 1662 | 1662-1680 |
| AD-68962.1 | UGAGGUAGCUGCACAAAGA | 605 | 1674 | 1674-1692 |
| AD-68963.1 | UAGCAAUGCGGAGGUAGCU | 606 | 1683 | 1683-1701 |
| AD-68964.1 | AGGGGUCACUACACAGCAA | 607 | 1696 | 1696-1714 |
| AD-68965.1 | ACGUCACAGGCAGGGGUCA | 608 | 1707 | 1707-1725 |
| AD-68966.1 | UGGGAUCCUCCACGUCACA | 609 | 1718 | 1718-1736 |
| AD-68967.1 | UCUCAGAGGCUGGGAUCCU | 610 | 1728 | 1728-1746 |
| AD-68968.1 | AAACCAACUCAGCUCAGAG | 611 | 1739 | 1739-1757 |
| AD-68969.1 | UAGCUUUCAUAAAACCAA | 612 | 1751 | 1751-1769 |
| AD-68970.1 | AGGUUGCUUCCUAGCUUUU | 613 | 1762 | 1762-1780 |
| AD-68971.1 | ACAGGCGAAAGGUUGCUUC | 614 | 1771 | 1771-1789 |
| AD-68972.1 | UGGACCGCUGCACAGGCGA | 615 | 1782 | 1782-1800 |
| AD-68973.1 | AGAGUUAAGUGCUGGACCG | 616 | 1794 | 1794-1812 |
| AD-68974.1 | UCUGAUGUAUUAGAGUUAA | 617 | 1805 | 1805-1823 |
| AD-68975.1 | AUUAACGCAUGCUGAUGUA | 618 | 1815 | 1815-1833 |
| AD-68976.1 | UCAACCAGCUGAAUUAACG | 619 | 1827 | 1827-1845 |
| AD-68977.1 | UGUGUCAUUUCCCAACCAG | 620 | 1838 | 1838-1856 |
| AD-68978.1 | UGGGCUUCCUGGUGUCAUU | 621 | 1848 | 1848-1866 |
| AD-68979.1 | UACCCUCUGCACUGGGCUU | 622 | 1860 | 1860-1878 |
| AD-68980.1 | AGUCAGUAAGGGACCCUCU | 623 | 1871 | 1871-1889 |
| AD-68981.1 | UCCACGAAACAGUCAGUAA | 624 | 1881 | 1881-1899 |
| AD-68982.1 | UCAUUAAUAGGGCCACGAA | 625 | 1892 | 1892-1910 |
| AD-68983.1 | UGAACAGUCUGACCAUUAA | 626 | 1904 | 1904-1922 |
| AD-68984.1 | ACCUCAUGCUGGAACAGUC | 627 | 1914 | 1914-1932 |
| AD-68985.1 | UGUCAUUCUAAGAACCUCA | 628 | 1927 | 1927-1945 |
| AD-68986.1 | UCAAACACCUGUCAUUCUA | 629 | 1936 | 1936-1954 |
| AD-68987.1 | UCCCCACCCAUCCAAACA | 630 | 1948 | 1948-1966 |
| AD-68988.1 | UCCCAUCACAAGGCCCCCA | 631 | 1960 | 1960-1978 |
| AD-68989.1 | UAGCCUACCCCCCAUCACA | 632 | 1969 | 1969-1987 |
| AD-68990.1 | UCACACAUGGGCCAGCCUA | 633 | 1981 | 1981-1999 |
| AD-68991.1 | UACCCCACAAGAUCACACA | 634 | 1993 | 1993-2011 |
| AD-68992.1 | UCUUCCCUCCACCCCACAA | 635 | 2002 | 2002-2020 |
| AD-68993.1 | UCAUGCUAUUCUCUUCCCU | 636 | 2013 | 2013-2031 |
| AD-68994.1 | UGGAAGUGGGAUCAUGCUA | 637 | 2024 | 2024-2042 |
| AD-68995.1 | UCCCACAGCAUGGGGAAGU | 638 | 2036 | 2036-2054 |

TABLE 4-continued

Unmodified Sense and Antisense Strand Sequences of PNPLA3 RNAi Agents

| | | | | |
|---|---|---|---|---|
| AD-68996.1 | ACUGCACCCUUCCCACAG | 639 | 2047 | 2047-2065 |
| AD-68997.1 | UCUUGGGACGAACUGCAC | 640 | 2059 | 2059-2077 |
| AD-68998.1 | UCAGUGUCGUUCUUGGGGA | 641 | 2069 | 2069-2087 |
| AD-69014.1 | ACCACCUGACAGGCAGUGU | 642 | 2081 | 2081-2099 |
| AD-69015.1 | AUCUUUGCAGACCACCUGA | 643 | 2091 | 2091-2109 |
| AD-69016.1 | UAAGGUUAUCAUCUUUGCA | 644 | 2101 | 2101-2119 |
| AD-69017.1 | GUUUUUAGUAGUCAAGGUU | 645 | 2113 | 2113-2131 |
| AD-69018.1 | UGCCAUGGAGACGUUUUUA | 646 | 2125 | 2125-2143 |
| AD-69019.1 | UUUGUUACCCCCGCCAUGG | 647 | 2136 | 2136-2154 |
| AD-69020.1 | AGAUUAUCAUCUUGUUACC | 648 | 2146 | 2146-2164 |
| AD-69021.1 | AAAAUUAAGUAGAUUAUCA | 649 | 2156 | 2156-2174 |
| AD-69022.1 | AAAGGUGUUCUAAAAUUAA | 650 | 2167 | 2167-2185 |
| AD-69023.1 | AGUUAGGUGAAAAAGGUGU | 651 | 2178 | 2178-2196 |
| AD-69024.1 | AAACAUUAUUUUAGUUAGG | 652 | 2190 | 2190-2208 |
| AD-69025.1 | AAAACUCUUUAAACAUUAU | 653 | 2200 | 2200-2218 |
| AD-69026.1 | ACAUUUUAUACAAAACUC | 654 | 2212 | 2212-2230 |
| AD-69027.1 | AACGCUUCCUUACAUUUUU | 655 | 2223 | 2223-2241 |
| AD-69028.1 | AACAGGUAACAACGCUUCC | 656 | 2233 | 2233-2251 |
| AD-69029.1 | AUACAAAAUUCAACAGGUA | 657 | 2244 | 2244-2262 |
| AD-69030.1 | ACUGAUUCACAUAAUACAA | 658 | 2257 | 2257-2275 |
| AD-69031.1 | ACUAACAUCUCACUGAUUC | 659 | 2268 | 2268-2286 |
| AD-69032.1 | AGGCUUAUUCUACUAACAU | 660 | 2279 | 2279-2297 |
| AD-69033.1 | UUUUUUUUUUAAGGCUUAU | 661 | 2290 | 2290-2308 |
| AD-69034.1 | AACCGAUUUUUUUUUUUUU | 662 | 2299 | 2299-2317 |
| AD-69035.1 | UCACUGCACCCAACCGAUU | 663 | 2310 | 2310-2328 |
| AD-69036.1 | ACAGCCGUGUGCCACUGCA | 664 | 2321 | 2321-2339 |
| AD-69037.1 | AAGUGCUGGGAUUACAGCC | 665 | 2334 | 2334-2352 |
| AD-69038.1 | UUGGCCUCCCAAAGUGCUG | 666 | 2345 | 2345-2363 |
| AD-69039.1 | AUCUGCCAACCUUGGCCUC | 667 | 2356 | 2356-2374 |
| AD-69040.1 | ACCUCAGGUGAUCUGCCAA | 668 | 2366 | 2366-2384 |
| AD-69041.1 | UUUGAACUCCUGACCUCAG | 669 | 2378 | 2378-2396 |
| AD-69042.1 | UCAGACUGGUCUUGAACUC | 670 | 2388 | 2388-2406 |
| AD-69043.1 | UGCUAUGUUGGCCAGACUG | 671 | 2399 | 2399-2417 |
| AD-69044.1 | UACAGGGUUUUGCUAUGUU | 672 | 2409 | 2409-2427 |
| AD-69045.1 | AUUUUUAGUAGAGACAGGG | 673 | 2421 | 2421-2439 |
| AD-69046.1 | AUAAUUUUUGUAUUUUUAG | 674 | 2432 | 2432-2450 |
| AD-69047.1 | ACCAUGCCCAGAUAAUUUU | 675 | 2443 | 2443-2461 |
| AD-69048.1 | AGGCAUGCACCACCAUGCC | 676 | 2454 | 2454-2472 |

TABLE 4-continued

Unmodified Sense and Antisense Strand Sequences of PNPLA3 RNAi Agents

| | | | | |
|---|---|---|---|---|
| AD-69049.1 | AGCUGGGAUUACAGGCAUG | 677 | 2466 | 2466-2484 |
| AD-69050.1 | UUUCCGAAUAGCUGGGAUU | 678 | 2475 | 2475-2493 |
| AD-69051.1 | UCUGCCUCAGCCUUCCGAA | 679 | 2486 | 2486-2504 |
| AD-69052.1 | UCAAGUGAUUCUCCUGCCU | 680 | 2498 | 2498-2516 |
| AD-69053.1 | UCUCCUGGGUUCAAGUGAU | 681 | 2508 | 2508-2526 |
| AD-69054.1 | UCGCAACCUCCGCCUCCUG | 682 | 2520 | 2520-2538 |
| AD-69055.1 | AAUCUCAGCUCACCGCAAC | 683 | 2532 | 2532-2550 |
| AD-69056.1 | UGAAAUGGUGCAAUCUCAG | 684 | 2543 | 2543-2561 |
| AD-69057.1 | AGGCUGGAAUGAAAUGGUG | 685 | 2552 | 2552-2570 |
| AD-69058.1 | ACUCAUGUUGCCCAGGCUG | 686 | 2565 | 2565-2583 |
| AD-69059.1 | UCAGACUUUCACUCAUGUU | 687 | 2575 | 2575-2593 |
| AD-69060.1 | UUUUUUUUUGAGUCAGACU | 688 | 2587 | 2587-2605 |
| AD-69061.1 | UUUUAAAUUUUUUUUUUUU | 689 | 2597 | 2597-2615 |
| AD-69062.1 | UAUUAUUUGUUUUUUAAA | 690 | 2609 | 2609-2627 |
| AD-69063.1 | UUGCACACUAGAUUAUUUU | 691 | 2619 | 2619-2637 |
| AD-69064.1 | AGGUGAAUGCCCUGCACAC | 692 | 2630 | 2630-2648 |
| AD-69065.1 | UGGGGGGCUGAGGUGAAUG | 693 | 2640 | 2640-2658 |
| AD-69066.1 | UUUGGCUCCUGCCUGGGGG | 694 | 2653 | 2653-2671 |
| AD-69067.1 | UCUGCUGUGCUUGGCUCCU | 695 | 2662 | 2662-2680 |
| AD-69068.1 | AGGCGGAAGCUCCUGCUGU | 696 | 2673 | 2673-2691 |
| AD-69069.1 | UAGUGGAGAGGAGGCGGAA | 697 | 2684 | 2684-2702 |
| AD-69070.1 | AGUUGUGUGCUCCAGUGGA | 698 | 2696 | 2696-2714 |
| AD-69071.1 | AGCCAGGUUCAAGUUGUGU | 699 | 2707 | 2707-2725 |
| AD-69072.1 | UCAGAAAAUAAGCCAGGUU | 700 | 2717 | 2717-2735 |
| AD-69073.1 | UGGGCUGGUCCCUGCAGAA | 701 | 2730 | 2730-2748 |
| AD-69074.1 | ACUGACCAUGUGGGGCUGG | 702 | 2741 | 2741-2759 |
| AD-69076.1 | UGCCACACAUGGGGAGAAA | 703 | 2763 | 2763-2781 |
| AD-69077.1 | CUUUAUUUCUACACUCUCU | 704 | 2785 | 2785-2803 |

TABLE 5

Modified Sense and Antisense Strand Sequences of PNPLA3 RNAi Agents

| Duplex Name | Sense Oligo Name | Sense Sequence (5'-3') | SEQ ID NO | Antisense Oligo Name | Antisense Sequence (5'-3') | SEQ ID NO |
|---|---|---|---|---|---|---|
| AD-68792.1 | A-138374.1 | GGGGGCGGGGCUGACGUCAdTdT | 705 | A-138375.1 | UGACGUCAGCCCCGCCCCCdTdT | 956 |
| AD-68793.1 | A-138376.1 | ACGUCGCGCUGGGAAUGCAdTdT | 706 | A-138377.1 | UGCAUUCCCAGCGCGACGUdTdT | 957 |
| AD-68794.1 | A-138378.1 | GGAAUGCCCUGGCCGAGAAdTdT | 707 | A-138379.1 | UUCUCGGCCAGGGCAUUCCdTdT | 958 |
| AD-68795.1 | A-138380.1 | UGGCCGAGACACUGAGGCAdTdT | 708 | A-138381.1 | UGCCUCAGUGUCUCGGCCAdTdT | 959 |
| AD-68796.1 | A-138382.1 | UGAGGCAGGGUAGAGAGCAdTdT | 709 | A-138383.1 | UGCUCUCUACCCUGCCUCAdTdT | 960 |

TABLE 5-continued

Modified Sense and Antisense Strand Sequences of PNPLA3 RNAi Agents

| Duplex Name | Sense Oligo Name | Sense Sequence (5'-3') | SEQ ID NO | Antisense Oligo Name | Antisense Sequence (5'-3') | SEQ ID NO |
|---|---|---|---|---|---|---|
| AD-68797.1 | A-138384.1 | AGAGAGCGCUUGCGGGCGAdTdT | 710 | A-138385.1 | UCGCCCGCAAGCGCUCUCUdTdT | 961 |
| AD-68798.1 | A-138386.1 | CGGGCGCCGGGCGGAGCUAdTdT | 711 | A-138387.1 | UAGCUCCGCCCGGCGCCCGdTdT | 962 |
| AD-68799.1 | A-138388.1 | GCGGAGCUGCUGCGGAUCAdTdT | 712 | A-138389.1 | UGAUCCGCAGCAGCUCCGCdTdT | 963 |
| AD-68800.1 | A-138390.1 | UGCGGAUCAGGACCCGAGAdTdT | 713 | A-138391.1 | UCUCGGGUCCUGAUCCGCAdTdT | 964 |
| AD-68801.1 | A-138392.1 | ACCCGAGCCGAUUCCCGAUdTdT | 714 | A-138393.1 | AUCGGGAAUCGGCUCGGGUdTdT | 965 |
| AD-68802.1 | A-138394.1 | UUCCCGAUCCCGACCCAGAdTdT | 715 | A-138395.1 | UCUGGGUCGGGAUCGGGAAdTdT | 966 |
| AD-68803.1 | A-138396.1 | ACCCAGAUCCUAACCCGCAdTdT | 716 | A-138397.1 | UGCGGGUUAGGAUCUGGGUdTdT | 967 |
| AD-68804.1 | A-138398.1 | UAACCCGCGCCCCCGCCCAdTdT | 717 | A-138399.1 | UGGGCGGGGGCGCGGGUUAdTdT | 968 |
| AD-68805.1 | A-138400.1 | CCGCCCCGCCGCCGCCGCAdTdT | 718 | A-138401.1 | UGCGGCGGCGGCGGGGCGGdTdT | 969 |
| AD-68806.1 | A-138402.1 | CGCCGCCAUGUACGACGCAdTdT | 719 | A-138403.1 | UGCGUCGUACAUGGCGGCGdTdT | 970 |
| AD-68807.1 | A-138404.1 | UACGACGCAGAGCGCGGCUdTdT | 720 | A-138405.1 | AGCCGCGCUCUGCGUCGUAdTdT | 971 |
| AD-68808.1 | A-138406.1 | CGCGGCUGGAGCUUGUCCUdTdT | 721 | A-138407.1 | AGGACAAGCUCCAGCCGCGdTdT | 972 |
| AD-68809.1 | A-138408.1 | AGCUUGUCCUUCGCGGGCUdTdT | 722 | A-138409.1 | AGCCCGCGAAGGACAAGCUdTdT | 973 |
| AD-68810.1 | A-138410.1 | CGCGGGCUGCGGCUUCCUAdTdT | 723 | A-138411.1 | UAGGAAGCCGCAGCCCGCGdTdT | 974 |
| AD-68811.1 | A-138412.1 | UUCCUGGGCUUCUACCACAdTdT | 724 | A-138413.1 | UGUGGUAGAAGCCCAGGAAdTdT | 975 |
| AD-68812.1 | A-138414.1 | UUCUACCACGUCGGGGCGAdTdT | 725 | A-138415.1 | UCGCCCCGACGUGGUAGAAdTdT | 976 |
| AD-68813.1 | A-138416.1 | CGGGGCGACCCGCUGCCUAdTdT | 726 | A-138417.1 | UAGGCAGCGGGUCGCCCCGdTdT | 977 |
| AD-68814.1 | A-138418.1 | UGCCUGAGCGAGCACGCCAdTdT | 727 | A-138419.1 | UGGCGUGCUCGCUCAGGCAdTdT | 978 |
| AD-68815.1 | A-138420.1 | AGCACGCCCCGCACCUCCUdTdT | 728 | A-138421.1 | AGGAGGUGCGGGGCGUGCUdTdT | 979 |
| AD-68816.1 | A-138422.1 | ACCUCCUCCGCGACGCGCAdTdT | 729 | A-138423.1 | UGCGCGUCGCGGAGGAGGUdTdT | 980 |
| AD-68817.1 | A-138424.1 | GCGACGCGCGCAUGUUGUUdTdT | 730 | A-138425.1 | AACAACAUGCGCGCGUCGCdTdT | 981 |
| AD-68818.1 | A-138426.1 | UGUUGUUCGGCGCUUCGGAdTdT | 731 | A-138427.1 | UCCGAAGCGCCGAACAACAdTdT | 982 |
| AD-68819.1 | A-138428.1 | CUUCGGCCGGGGCGUUGCAdTdT | 732 | A-138429.1 | UGCAACGCCCCGGCCGAAGdTdT | 983 |
| AD-68820.1 | A-138430.1 | GGCGUUGCACUGCGUCGGAdTdT | 733 | A-138431.1 | UCCGACGCAGUGCAACGCCdTdT | 984 |
| AD-68821.1 | A-138432.1 | UGCGUCGGCGUCCUCUCCAdTdT | 734 | A-138433.1 | UGGAGAGGACGCCGACGCAdTdT | 985 |
| AD-68822.1 | A-138434.1 | UCUCCGGUAUCCCGCUGGAdTdT | 735 | A-138435.1 | UCCAGCGGGAUACCGGAGAdTdT | 986 |
| AD-68823.1 | A-138436.1 | UCCCGCUGGAGCAGACUCUdTdT | 736 | A-138437.1 | AGAGUCUGCUCCAGCGGGAdTdT | 987 |
| AD-68824.1 | A-138438.1 | CAGACUCUGCAGGUCCUCUdTdT | 737 | A-138439.1 | AGAGGACCUGCAGAGUCUGdTdT | 988 |
| AD-68825.1 | A-138440.1 | UCCUCUCAGAUCUUGUGCAdTdT | 738 | A-138441.1 | UGCACAAGAUCUGAGAGGAdTdT | 989 |
| AD-68826.1 | A-138442.1 | UCUUGUGCGGAAGGCCAGAdTdT | 739 | A-138443.1 | UCUGGCCUUCCGCACAAGAdTdT | 990 |
| AD-68827.1 | A-138444.1 | AAGGCCAGGAGUCGGAACAdTdT | 740 | A-138445.1 | UGUUCCGACUCCUGGCCUUdTdT | 991 |
| AD-68828.1 | A-138446.1 | CGGAACAUGGCAUCUUCAdTdT | 741 | A-138447.1 | UGAAGAUGCCAUGUUCCGdTdT | 992 |
| AD-68829.1 | A-138448.1 | GCAUCUUCCAUCCAUCCUUdTdT | 742 | A-138449.1 | AAGGAUGGAUGGAAGAUGCdTdT | 993 |
| AD-68830.1 | A-138450.1 | CCAUCCUUCAACUUAAGCAdTdT | 743 | A-138451.1 | UGCUUAAGUUGAAGGAUGGdTdT | 994 |
| AD-68831.1 | A-138452.1 | UUAAGCAAGUUCCUCCGAAdTdT | 744 | A-138453.1 | UUCGGAGGAACUUGCUUAAdTdT | 995 |
| AD-68832.1 | A-138454.1 | CCUCCGACAGGGUCUCUGAdTdT | 745 | A-138455.1 | UCAGAGACCCUGUCGGAGGdTdT | 996 |
| AD-68833.1 | A-138456.1 | UCUCUGCAAAUGCCUCCCAdTdT | 746 | A-138457.1 | UGGGAGGCAUUUGCAGAGAdTdT | 997 |

TABLE 5-continued

Modified Sense and Antisense Strand Sequences of PNPLA3 RNAi Agents

| Duplex Name | Sense Oligo Name | Sense Sequence (5'-3') | SEQ ID NO | Antisense Oligo Name | Antisense Sequence (5'-3') | SEQ ID NO |
|---|---|---|---|---|---|---|
| AD-68834.1 | A-138458.1 | UGCCUCCCGGCCAAUGUCAdTdT | 747 | A-138459.1 | UGACAUUGGCCGGGAGGCAdTdT | 998 |
| AD-68835.1 | A-138460.1 | AAUGUCCACCAGCUCAUCUdTdT | 748 | A-138461.1 | AGAUGAGCUGGUGGACAUUdTdT | 999 |
| AD-68836.1 | A-138462.1 | AGCUCAUCUCCGGCAAAAUdTdT | 749 | A-138463.1 | AUUUUGCCGGAGAUGAGCUdTdT | 1000 |
| AD-68837.1 | A-138464.1 | CGGCAAAAUAGGCAUCUCUdTdT | 750 | A-138465.1 | AGAGAUGCCUAUUUUGCCGdTdT | 1001 |
| AD-68838.1 | A-138466.1 | AUCUCUCUUACCAGAGUGUdTdT | 751 | A-138467.1 | ACACUCUGGUAAGAGAGAUdTdT | 1002 |
| AD-68839.1 | A-138468.1 | ACCAGAGUGUCUGAUGGGAdTdT | 752 | A-138469.1 | UCCCAUCAGACACUCUGGUdTdT | 1003 |
| AD-68840.1 | A-138470.1 | AUGGGGAAAACGUUCUGGUdTdT | 753 | A-138471.1 | ACCAGAACGUUUUCCCCAUdTdT | 1004 |
| AD-68841.1 | A-138472.1 | ACGUUCUGGUGUCUGACUUdTdT | 754 | A-138473.1 | AAGUCAGACACCAGAACGUdTdT | 1005 |
| AD-68842.1 | A-138474.1 | UCUGACUUUCGGUCCAAAGdTdT | 755 | A-138475.1 | CUUUGGACCGAAAGUCAGAdTdT | 1006 |
| AD-68843.1 | A-138476.1 | UCCAAAGACGAAGUCGUGAdTdT | 756 | A-138477.1 | UCACGACUUCGUCUUUGGAdTdT | 1007 |
| AD-68844.1 | A-138478.1 | AAGUCGUGGAUGCCUUGGUdTdT | 757 | A-138479.1 | ACCAAGGCAUCCACGACUUdTdT | 1008 |
| AD-68845.1 | A-138480.1 | CCUUGGUAUGUUCCUGCUUdTdT | 758 | A-138481.1 | AAGCAGGAACAUACCAAGGdTdT | 1009 |
| AD-68846.1 | A-138482.1 | UCCUGCUUCAUCCCCUUCUdTdT | 759 | A-138483.1 | AGAAGGGGAUGAAGCAGGAdTdT | 1010 |
| AD-68847.1 | A-138484.1 | UCCCCUUCUACAGUGGCCUdTdT | 760 | A-138485.1 | AGGCCACUGUAGAAGGGGAdTdT | 1011 |
| AD-68848.1 | A-138486.1 | AGUGGCCUUAUCCUCCUUdTdT | 761 | A-138487.1 | AAGGAGGGAUAAGGCCACUdTdT | 1012 |
| AD-68849.1 | A-138488.1 | CCUCCUUCCUUCAGAGGCAdTdT | 762 | A-138489.1 | UGCCUCUGAAGGAAGGAGGdTdT | 1013 |
| AD-68850.1 | A-138490.1 | UCAGAGGCGUGCGAUAUGUdTdT | 763 | A-138491.1 | ACAUAUCGCACGCCUCUGAdTdT | 1014 |
| AD-68851.1 | A-138492.1 | GAUAUGUGGAUGGAGGAGUdTdT | 764 | A-138493.1 | ACUCCUCCAUCCACAUAUCdTdT | 1015 |
| AD-68852.1 | A-138494.1 | GAGGAGUGAGUGACAACGUdTdT | 765 | A-138495.1 | ACGUUGUCACUCACUCCUCdTdT | 1016 |
| AD-68853.1 | A-138496.1 | UGACAACGUACCCUUCAUdTdT | 766 | A-138497.1 | AAUGAAGGGUACGUUGUCAdTdT | 1017 |
| AD-68854.1 | A-138498.1 | CCUUCAUUGAUGCCAAAACdTdT | 767 | A-138499.1 | GUUUUGGCAUCAAUGAAGGdTdT | 1018 |
| AD-68855.1 | A-138500.1 | UGCCAAAACAACCAUCACAdTdT | 768 | A-138501.1 | UGUGAUGGUUGUUUUGGCAdTdT | 1019 |
| AD-68856.1 | A-138502.1 | AUCACCGUGUCCCCCUUCUdTdT | 769 | A-138503.1 | AGAAGGGGACACGGUGAUdTdT | 1020 |
| AD-68857.1 | A-138504.1 | UCCCCCUUCUAUGGGGAGUdTdT | 770 | A-138505.1 | ACUCCCCAUAGAAGGGGAdTdT | 1021 |
| AD-68858.1 | A-138506.1 | UGGGGAGUACGACAUCUGAdTdT | 771 | A-138507.1 | UCAGAUGUCGUACUCCCCAdTdT | 1022 |
| AD-68859.1 | A-138508.1 | AUCUGCCCUAAAGUCAAGUdTdT | 772 | A-138509.1 | ACUUGACUUUAGGGCAGAUdTdT | 1023 |
| AD-68860.1 | A-138510.1 | AGUCAAGUCCACGAACUUUdTdT | 773 | A-138511.1 | AAAGUUCGUGGACUUGACUdTdT | 1024 |
| AD-68861.1 | A-138512.1 | ACGAACUUUCUUCAUGUGAdTdT | 774 | A-138513.1 | UCACAUGAAGAAAGUUCGUdTdT | 1025 |
| AD-68862.1 | A-138514.1 | UUCAUGUGGACAUCACCAAdTdT | 775 | A-138515.1 | UUGGUGAUGUCCACAUGAAdTdT | 1026 |
| AD-68863.1 | A-138516.1 | UCACCAAGCUCAGUCUACAdTdT | 776 | A-138517.1 | UGUAGACUGAGCUUGGUGAdTdT | 1027 |
| AD-68864.1 | A-138518.1 | AGUCUACGCCUCUGCACAAdTdT | 777 | A-138519.1 | UUGUGCAGAGGCGUAGACUdTdT | 1028 |
| AD-68865.1 | A-138520.1 | CUGCACAGGGAACCUCUAAdTdT | 778 | A-138521.1 | UUAGAGGUUCCCUGUGCAGdTdT | 1029 |
| AD-68866.1 | A-138522.1 | AACCUCUACCUUCUCUCGAdTdT | 779 | A-138523.1 | UCGAGAGAAGGUAGAGGUUdTdT | 1030 |
| AD-68867.1 | A-138524.1 | UCUCGAGAGCUUUUGUCCAdTdT | 780 | A-138525.1 | UGGACAAAAGCUCUCGAGAdTdT | 1031 |
| AD-68868.1 | A-138526.1 | UUUGUCCCCCCGGAUCUCAdTdT | 781 | A-138527.1 | UGAGAUCCGGGGGACAAAdTdT | 1032 |
| AD-68869.1 | A-138528.1 | CCGGAUCUCAAGGUGCUGAdTdT | 782 | A-138529.1 | UCAGCACCUUGAGAUCCGGdTdT | 1033 |
| AD-68870.1 | A-138530.1 | UGCUGGGAGAGAUAUGCCUdTdT | 783 | A-138531.1 | AGGCAUAUCUCUCCCAGCAdTdT | 1034 |

TABLE 5-continued

Modified Sense and Antisense Strand Sequences of PNPLA3 RNAi Agents

| Duplex Name | Sense Oligo Name | Sense Sequence (5'-3') | SEQ ID NO | Antisense Oligo Name | Antisense Sequence (5'-3') | SEQ ID NO |
|---|---|---|---|---|---|---|
| AD-68871.1 | A-138532.1 | AGAUAUGCCUUCGAGGAUAdTdT | 784 | A-138533.1 | UAUCCUCGAAGGCAUAUCUdTdT | 1035 |
| AD-68872.1 | A-138534.1 | AGGAUAUUUGGAUGCAUUAdTdT | 785 | A-138535.1 | UAAUGCAUCCAAAUAUCCUdTdT | 1036 |
| AD-68873.1 | A-138536.1 | AUGCAUUCAGGUUCUUGGAdTdT | 786 | A-138537.1 | UCCAAGAACCUGAAUGCAUdTdT | 1037 |
| AD-68874.1 | A-138538.1 | UUCUUGGAAGAGAAGGGCAdTdT | 787 | A-138539.1 | UGCCCUUCUCUUCCAAGAAdTdT | 1038 |
| AD-68875.1 | A-138540.1 | GAGAAGGGCAUCUGCAACAdTdT | 788 | A-138541.1 | UGUUGCAGAUGCCCUUCUCdTdT | 1039 |
| AD-68876.1 | A-138542.1 | UGCAACAGGCCCCAGCCAAdTdT | 789 | A-138543.1 | UUGGCUGGGGCCUGUUGCAdTdT | 1040 |
| AD-68877.1 | A-138544.1 | CAGCCAGGCCUGAAGUCAUdTdT | 790 | A-138545.1 | AUGACUUCAGGCCUGGCUGdTdT | 1041 |
| AD-68878.1 | A-138546.1 | GAAGUCAUCCUCAGAAGGAdTdT | 791 | A-138547.1 | UCCUUCUGAGGAUGACUUCdTdT | 1042 |
| AD-68879.1 | A-138548.1 | UCAGAAGGGAUGGAUCCUAdTdT | 792 | A-138549.1 | UAGGAUCCAUCCCUUCUGAdTdT | 1043 |
| AD-68880.1 | A-138550.1 | UGGAUCCUGAGGUCGCCAUdTdT | 793 | A-138551.1 | AUGGCGACCUCAGGAUCCAdTdT | 1044 |
| AD-68881.1 | A-138552.1 | CGCCAUGCCCAGCUGGGCAdTdT | 794 | A-138553.1 | UGCCCAGCUGGGCAUGGCGdTdT | 1045 |
| AD-68882.1 | A-138554.1 | CAGCUGGGCAAACAUGAGUdTdT | 795 | A-138555.1 | ACUCAUGUUUGCCCAGCUGdTdT | 1046 |
| AD-68883.1 | A-138556.1 | CAUGAGUCUGGAUUCUUCAdTdT | 796 | A-138557.1 | UGAAGAAUCCAGACUCAUGdTdT | 1047 |
| AD-68884.1 | A-138558.1 | UUCUUCCCGGAGUCGGCUdTdT | 797 | A-138559.1 | AGCCGACUCCGGGAAGAAdTdT | 1048 |
| AD-68885.1 | A-138560.1 | AGUCGGCUGCCUUGGCUGUdTdT | 798 | A-138561.1 | ACAGCCAAGGCAGCCGACUdTdT | 1049 |
| AD-68905.1 | A-138562.1 | UUGGCUGUGAGGCUGGAGAdTdT | 799 | A-138563.1 | UCUCCAGCCUCACAGCCAAdTdT | 1050 |
| AD-68906.1 | A-138564.1 | AGGCUGGAGGGAGAUGAGAdTdT | 800 | A-138565.1 | UCUCAUCUCCCUCCAGCCUdTdT | 1051 |
| AD-68907.1 | A-138566.1 | AUGAGCUGCUAGACCACCUdTdT | 801 | A-138567.1 | AGGUGGUCUAGCAGCUCAUdTdT | 1052 |
| AD-68908.1 | A-138568.1 | UAGACCACCUGCGUCUCAdTdT | 802 | A-138569.1 | UUGAGACGCAGGUGGUCUAdTdT | 1053 |
| AD-68909.1 | A-138570.1 | CGUCUCAGCAUCCUGCCCUdTdT | 803 | A-138571.1 | AGGGCAGGAUGCUGAGACGdTdT | 1054 |
| AD-68910.1 | A-138572.1 | CCUGCCCUGGGAUGAGAGAdTdT | 804 | A-138573.1 | UCUCUCAUCCCAGGGCAGGdTdT | 1055 |
| AD-68911.1 | A-138574.1 | AUGAGAGCAUCCUGGACAAdTdT | 805 | A-138575.1 | UUGUCCAGGAUGCUCUCAUdTdT | 1056 |
| AD-68912.1 | A-138576.1 | UGGACACCCUCUCGCCCAAdTdT | 806 | A-138577.1 | UUGGGCGAGAGGGUGUCCAdTdT | 1057 |
| AD-68913.1 | A-138578.1 | UCGCCCAGGCUCGCUACAAdTdT | 807 | A-138579.1 | UUGUAGCGAGCCUGGGCGAdTdT | 1058 |
| AD-68914.1 | A-138580.1 | UCGCUACAGCACUGAGUGAdTdT | 808 | A-138581.1 | UCACUCAGUGCUGUAGCGAdTdT | 1059 |
| AD-68915.1 | A-138582.1 | CUGAGUGAAGAAAUGAAAGdTdT | 809 | A-138583.1 | CUUUCAUUUCUUCACUCAGdTdT | 1060 |
| AD-68916.1 | A-138584.1 | AUGAAAGACAAAGGUGGAUdTdT | 810 | A-138585.1 | AUCCACCUUUGUCUUUCAUdTdT | 1061 |
| AD-68917.1 | A-138586.1 | AAGGUGGAUACAUGAGCAAdTdT | 811 | A-138587.1 | UUGCUCAUGUAUCCACCUUdTdT | 1062 |
| AD-68918.1 | A-138588.1 | AUGAGCAAGAUUUGCAACUdTdT | 812 | A-138589.1 | AGUUGCAAAUCUUGCUCAUdTdT | 1063 |
| AD-68919.1 | A-138590.1 | UUGCAACUUGCUACCCAUUdTdT | 813 | A-138591.1 | AAUGGGUAGCAAGUUGCAAdTdT | 1064 |
| AD-68920.1 | A-138592.1 | ACCCAUUAGGAUAAUGUCUdTdT | 814 | A-138593.1 | AGACAUUAUCCUAAUGGGUdTdT | 1065 |
| AD-68921.1 | A-138594.1 | UAAUGUCUUAUGUAAUGCUdTdT | 815 | A-138595.1 | AGCAUUACAUAAGACAUUAdTdT | 1066 |
| AD-68922.1 | A-138596.1 | UAAUGCUGCCCUGUACCCUdTdT | 816 | A-138597.1 | AGGGUACAGGGCAGCAUUAdTdT | 1067 |
| AD-68923.1 | A-138598.1 | UGUACCCUGCCUGUGGAAUdTdT | 817 | A-138599.1 | AUUCCACAGGCAGGGUACAdTdT | 1068 |
| AD-68924.1 | A-138600.1 | UGUGGAAUCUGCCAUUGCAdTdT | 818 | A-138601.1 | UGCAAUGGCAGAUUCCACAdTdT | 1069 |
| AD-68925.1 | A-138602.1 | UGCCAUUGCGAUUGUCCAAdTdT | 819 | A-138603.1 | UUGGACAAUCGCAAUGGCAdTdT | 1070 |
| AD-68926.1 | A-138604.1 | UUGUCCAGAGACUGGUGAAdTdT | 820 | A-138605.1 | UUCACCAGUCUCUGGACAAdTdT | 1071 |

TABLE 5-continued

Modified Sense and Antisense Strand Sequences of PNPLA3 RNAi Agents

| Duplex Name | Sense Oligo Name | Sense Sequence (5'-3') | SEQ ID NO | Antisense Oligo Name | Antisense Sequence (5'-3') | SEQ ID NO |
|---|---|---|---|---|---|---|
| AD-68927.1 | A-138606.1 | GGUGACAUGGCUUCCAGAUdTdT | 821 | A-138607.1 | AUCUGGAAGCCAUGUCACCdTdT | 1072 |
| AD-68928.1 | A-138608.1 | UUCCAGAUAUGCCCGACGAdTdT | 822 | A-138609.1 | UCGUCGGGCAUAUCUGGAAdTdT | 1073 |
| AD-68929.1 | A-138610.1 | UGCCCGACGAUGUCCUGUAdTdT | 823 | A-138611.1 | UACAGGACAUCGUCGGGCAdTdT | 1074 |
| AD-68930.1 | A-138612.1 | UCCUGUGGUUGCAGUGGGUdTdT | 824 | A-138613.1 | ACCCACUGCAACCACAGGAdTdT | 1075 |
| AD-68931.1 | A-138614.1 | AGUGGGUGACCUCACAGGUdTdT | 825 | A-138615.1 | ACCUGUGAGGUCACCCACUdTdT | 1076 |
| AD-68932.1 | A-138616.1 | UCACAGGUGUUCACUCGAAdTdT | 826 | A-138617.1 | UUCGAGUGAACACCUGUGAdTdT | 1077 |
| AD-68933.1 | A-138618.1 | UUCACUCGAGUGCUGAUGUdTdT | 827 | A-138619.1 | ACAUCAGCACUCGAGUGAAdTdT | 1078 |
| AD-68934.1 | A-138620.1 | UGAUGUGUCUGCUCCCCGAdTdT | 828 | A-138621.1 | UCGGGGAGCAGACACAUCAdTdT | 1079 |
| AD-68935.1 | A-138622.1 | UGCUCCCCGCCUCCAGGUdTdT | 829 | A-138623.1 | UACCUGGAGGCGGGGAGCAdTdT | 1080 |
| AD-68936.1 | A-138624.1 | CCAGGUCCCAAAUGCCAGUdTdT | 830 | A-138625.1 | ACUGGCAUUUGGGACCUGGdTdT | 1081 |
| AD-68937.1 | A-138626.1 | AAUGCCAGUGAGCAGCCAAdTdT | 831 | A-138627.1 | UUGGCUGCUCACUGGCAUUdTdT | 1082 |
| AD-68938.1 | A-138628.1 | AGCCAACAGGCCUCCCCAUdTdT | 832 | A-138629.1 | AUGGGGAGGCCUGUUGGCUdTdT | 1083 |
| AD-68939.1 | A-138630.1 | CCUCCCCAUGCACACCUGAdTdT | 833 | A-138631.1 | UCAGGUGUGCAUGGGGAGGdTdT | 1084 |
| AD-68940.1 | A-138632.1 | CACCUGAGCAGGACUGGCAdTdT | 834 | A-138633.1 | UGCCAGUCCUGCUCAGGUGdTdT | 1085 |
| AD-68941.1 | A-138634.1 | GACUGGCCCUGCUGGACUAdTdT | 835 | A-138635.1 | UAGUCCAGCAGGGCCAGUCdTdT | 1086 |
| AD-68942.1 | A-138636.1 | UGCUGGACUCCCUGCUCCAdTdT | 836 | A-138637.1 | UGGAGCAGGGAGUCCAGCAdTdT | 1087 |
| AD-68943.1 | A-138638.1 | CUGCUCCCCCAAGGGCUGUdTdT | 837 | A-138639.1 | ACAGCCCUUGGGGGAGCAGdTdT | 1088 |
| AD-68944.1 | A-138640.1 | AGGGCUGUCCAGCAGAGAAdTdT | 838 | A-138641.1 | UUCUCUGCUGGACAGCCCUdTdT | 1089 |
| AD-68945.1 | A-138642.1 | CAGAGACCAAAGCAGAGGAdTdT | 839 | A-138643.1 | UCCUCUGCUUUGGUCUCUGdTdT | 1090 |
| AD-68946.1 | A-138644.1 | AGCAGAGGCCACCCCGCGAdTdT | 840 | A-138645.1 | UCGCGGGGUGGCCUCUGCUdTdT | 1091 |
| AD-68947.1 | A-138646.1 | CCGCGGUCCAUCCUCAGGUdTdT | 841 | A-138647.1 | ACCUGAGGAUGGACCGCGGdTdT | 1092 |
| AD-68948.1 | A-138648.1 | CCUCAGGUCCAGCCUGAAAdTdT | 842 | A-138649.1 | UUUCAGGCUGGACCUGAGGdTdT | 1093 |
| AD-68949.1 | A-138650.1 | AGCCUGAACUUCUUCUUGAdTdT | 843 | A-138651.1 | UCAAGAAGAAGUUCAGGCUdTdT | 1094 |
| AD-68950.1 | A-138652.1 | UUCUUGGGCAAUAAAGUAAdTdT | 844 | A-138653.1 | UUACUUUAUUGCCCAAGAAdTdT | 1095 |
| AD-68951.1 | A-138654.1 | UAAAGUACCUGCUGGUGCUdTdT | 845 | A-138655.1 | AGCACCAGCAGGUACUUUAdTdT | 1096 |
| AD-68952.1 | A-138656.1 | CUGGUGCUGAGGGGCUCUAdTdT | 846 | A-138657.1 | UAGAGCCCCUCAGCACCAGdTdT | 1097 |
| AD-68953.1 | A-138658.1 | AGGGGCUCUCCACCUUUCAdTdT | 847 | A-138659.1 | UGAAAGGUGGAGAGCCCCUdTdT | 1098 |
| AD-68954.1 | A-138660.1 | CCUUUCCCAGUUUUUCACUdTdT | 848 | A-138661.1 | AGUGAAAAACUGGGAAAGGdTdT | 1099 |
| AD-68955.1 | A-138662.1 | UUUUUCACUAGAGAAGAGUdTdT | 849 | A-138663.1 | ACUCUUCUCUAGUGAAAAAdTdT | 1100 |
| AD-68956.1 | A-138664.1 | AAGAGUCUGUGAGUCACUUdTdT | 850 | A-138665.1 | AAGUGACUCACAGACUCUUdTdT | 1101 |
| AD-68957.1 | A-138666.1 | AGUCACUUGAGGAGGCGAAdTdT | 851 | A-138667.1 | UUCGCCUCCUCAAGUGACUdTdT | 1102 |
| AD-68958.1 | A-138668.1 | AGGAGGCGAGUCUAGCAGAdTdT | 852 | A-138669.1 | UCUGCUAGACUCGCCUCCUdTdT | 1103 |
| AD-68959.1 | A-138670.1 | AGCAGAUUCUUUCAGAGGUdTdT | 853 | A-138671.1 | ACCUCUGAAAGAAUCUGCUdTdT | 1104 |
| AD-68960.1 | A-138672.1 | UUCAGAGGUGCUAAAGUUUdTdT | 854 | A-138673.1 | AAACUUUAGCACCUCUGAAdTdT | 1105 |
| AD-68961.1 | A-138674.1 | UAAAGUUUCCCAUCUUUGUdTdT | 855 | A-138675.1 | ACAAAGAUGGGAAACUUUAdTdT | 1106 |
| AD-68962.1 | A-138676.1 | UCUUUGUGCAGCUACCUCAdTdT | 856 | A-138677.1 | UGAGGUAGCUGCACAAAGAdTdT | 1107 |
| AD-68963.1 | A-138678.1 | AGCUACCUCCGCAUUGCUAdTdT | 857 | A-138679.1 | UAGCAAUGCGGAGGUAGCUdTdT | 1108 |

TABLE 5-continued

Modified Sense and Antisense Strand Sequences of PNPLA3 RNAi Agents

| Duplex Name | Sense Oligo Name | Sense Sequence (5'-3') | SEQ ID NO | Antisense Oligo Name | Antisense Sequence (5'-3') | SEQ ID NO |
|---|---|---|---|---|---|---|
| AD-68964.1 | A-138680.1 | UUGCUGUGUAGUGACCCCUdTdT | 858 | A-138681.1 | AGGGGUCACUACACAGCAAdTdT | 1109 |
| AD-68965.1 | A-138682.1 | UGACCCCUGCCUGUGACGUdTdT | 859 | A-138683.1 | ACGUCACAGGCAGGGGUCAdTdT | 1110 |
| AD-68966.1 | A-138684.1 | UGUGACGUGGAGGAUCCCAdTdT | 860 | A-138685.1 | UGGGAUCCUCCACGUCACAdTdT | 1111 |
| AD-68967.1 | A-138686.1 | AGGAUCCCAGCCUCUGAGAdTdT | 861 | A-138687.1 | UCUCAGAGGCUGGGAUCCUdTdT | 1112 |
| AD-68968.1 | A-138688.1 | CUCUGAGCUGAGUUGGUUUdTdT | 862 | A-138689.1 | AAACCAACUCAGCUCAGAGdTdT | 1113 |
| AD-68969.1 | A-138690.1 | UUGGUUUUAUGAAAAGCUdTdT | 863 | A-138691.1 | UAGCUUUUCAUAAAACCAAdTdT | 1114 |
| AD-68970.1 | A-138692.1 | AAAAGCUAGGAAGCAACCUdTdT | 864 | A-138693.1 | AGGUUGCUUCCUAGCUUUUdTdT | 1115 |
| AD-68971.1 | A-138694.1 | GAAGCAACCUUUCGCCUGUdTdT | 865 | A-138695.1 | ACAGGCGAAAGGUUGCUUCdTdT | 1116 |
| AD-68972.1 | A-138696.1 | UCGCCUGUGCAGCGGUCCAdTdT | 866 | A-138697.1 | UGGACCGCUGCACAGGCGAdTdT | 1117 |
| AD-68973.1 | A-138698.1 | CGGUCCAGCACUUAACUCUdTdT | 867 | A-138699.1 | AGAGUUAAGUGCUGGACCGdTdT | 1118 |
| AD-68974.1 | A-138700.1 | UUAACUCUAAUACAUCAGAdTdT | 868 | A-138701.1 | UCUGAUGUAUUAGAGUUAAdTdT | 1119 |
| AD-68975.1 | A-138702.1 | UACAUCAGCAUGCGUUAAUdTdT | 869 | A-138703.1 | AUUAACGCAUGCUGAUGUAdTdT | 1120 |
| AD-68976.1 | A-138704.1 | CGUUAAUUCAGCUGGUUGAdTdT | 870 | A-138705.1 | UCAACCAGCUGAAUUAACGdTdT | 1121 |
| AD-68977.1 | A-138706.1 | CUGGUUGGGAAAUGACACAdTdT | 871 | A-138707.1 | UGUGUCAUUUCCCAACCAGdTdT | 1122 |
| AD-68978.1 | A-138708.1 | AAUGACACCAGGAAGCCCAdTdT | 872 | A-138709.1 | UGGGCUUCCUGGUGUCAUUdTdT | 1123 |
| AD-68979.1 | A-138710.1 | AAGCCCAGUGCAGAGGGUAdTdT | 873 | A-138711.1 | UACCCUCUGCACUGGGCUUdTdT | 1124 |
| AD-68980.1 | A-138712.1 | AGAGGGUCCCUUACUGACUdTdT | 874 | A-138713.1 | AGUCAGUAAGGGACCCUCUdTdT | 1125 |
| AD-68981.1 | A-138714.1 | UUACUGACUGUUUCGUGGAdTdT | 875 | A-138715.1 | UCCACGAAACAGUCAGUAAdTdT | 1126 |
| AD-68982.1 | A-138716.1 | UUCGUGGCCCUAUUAAUGAdTdT | 876 | A-138717.1 | UCAUUAAUAGGGCCACGAAdTdT | 1127 |
| AD-68983.1 | A-138718.1 | UUAAUGGUCAGACUGUUCAdTdT | 877 | A-138719.1 | UGAACAGUCUGACCAUUAAdTdT | 1128 |
| AD-68984.1 | A-138720.1 | GACUGUUCCAGCAUGAGGUdTdT | 878 | A-138721.1 | ACCUCAUGCUGGAACAGUCdTdT | 1129 |
| AD-68985.1 | A-138722.1 | UGAGGUUCUUAGAAUGACAdTdT | 879 | A-138723.1 | UGUCAUUCUAAGAACCUCAdTdT | 1130 |
| AD-68986.1 | A-138724.1 | UAGAAUGACAGGUGUUUGAdTdT | 880 | A-138725.1 | UCAAACACCUGUCAUUCUAdTdT | 1131 |
| AD-68987.1 | A-138726.1 | UGUUUGGAUGGUGGGGGAdTdT | 881 | A-138727.1 | UCCCCCACCCAUCCAAACAdTdT | 1132 |
| AD-68988.1 | A-138728.1 | UGGGGGCCUUGUGAUGGGAdTdT | 882 | A-138729.1 | UCCCAUCACAAGGCCCCCAdTdT | 1133 |
| AD-68989.1 | A-138730.1 | UGUGAUGGGGGUAGGCUAdTdT | 883 | A-138731.1 | UAGCCUACCCCCAUCACAdTdT | 1134 |
| AD-68990.1 | A-138732.1 | UAGGCUGGCCCAUGUGUGAdTdT | 884 | A-138733.1 | UCACACAUGGGCCAGCCUAdTdT | 1135 |
| AD-68991.1 | A-138734.1 | UGUGUGAUCUUGUGGGGUAdTdT | 885 | A-138735.1 | UACCCCACAAGAUCACACAdTdT | 1136 |
| AD-68992.1 | A-138736.1 | UUGUGGGGUGGAGGGAAGAdTdT | 886 | A-138737.1 | UCUUCCCUCCACCCCACAdTdT | 1137 |
| AD-68993.1 | A-138738.1 | AGGGAAGAGAAUAGCAUGAdTdT | 887 | A-138739.1 | UCAUGCUAUUCUCUUCCCUdTdT | 1138 |
| AD-68994.1 | A-138740.1 | UAGCAUGAUCCCACUUCCAdTdT | 888 | A-138741.1 | UGGAAGUGGGAUCAUGCUAdTdT | 1139 |
| AD-68995.1 | A-138742.1 | ACUUCCCAUGCUGUGGGAdTdT | 889 | A-138743.1 | UCCCACAGCAUGGGGAAGUdTdT | 1140 |
| AD-68996.1 | A-138744.1 | CUGUGGGAAGGGUGCAGUdTdT | 890 | A-138745.1 | ACUGCACCCCUUCCCACAGdTdT | 1141 |
| AD-68997.1 | A-138746.1 | GUGCAGUUCGUCCCCAAGAdTdT | 891 | A-138747.1 | UCUUGGGGACGAACUGCACdTdT | 1142 |
| AD-68998.1 | A-138748.1 | UCCCCAAGAACGACACUGAdTdT | 892 | A-138749.1 | UCAGUGUCGUUCUUGGGGAdTdT | 1143 |
| AD-69014.1 | A-138750.1 | ACACUGCCUGUCAGGUGGAdTdT | 893 | A-138751.1 | ACCACCUGACAGGCAGUGUdTdT | 1144 |
| AD-69015.1 | A-138752.1 | UCAGGUGGUCUGCAAAGAUdTdT | 894 | A-138753.1 | AUCUUUGCAGACCACCUGAdTdT | 1145 |

TABLE 5-continued

Modified Sense and Antisense Strand Sequences of PNPLA3 RNAi Agents

| Duplex Name | Sense Oligo Name | Sense Sequence (5'-3') | SEQ ID NO | Antisense Oligo Name | Antisense Sequence (5'-3') | SEQ ID NO |
|---|---|---|---|---|---|---|
| AD-69016.1 | A-138754.1 | UGCAAAGAUGAUAACCUUAdTdT | 895 | A-138755.1 | UAAGGUUAUCAUCUUUGCAdTdT | 1146 |
| AD-69017.1 | A-138756.1 | AACCUUGACUACUAAAAACdTdT | 896 | A-138757.1 | GUUUUUAGUAGUCAAGGUUdTdT | 1147 |
| AD-69018.1 | A-138758.1 | UAAAAACGUCUCCAUGGCAdTdT | 897 | A-138759.1 | UGCCAUGGAGACGUUUUUAdTdT | 1148 |
| AD-69019.1 | A-138760.1 | CCAUGGCGGGGGUAACAAAdTdT | 898 | A-138761.1 | UUUGUUACCCCCGCCAUGGdTdT | 1149 |
| AD-69020.1 | A-138762.1 | GGUAACAAGAUGAUAAUCUdTdT | 899 | A-138763.1 | AGAUUAUCAUCUUGUUACCdTdT | 1150 |
| AD-69021.1 | A-138764.1 | UGAUAAUCUACUUAAUUUUdTdT | 900 | A-138765.1 | AAAAUUAAGUAGAUUAUCAdTdT | 1151 |
| AD-69022.1 | A-138766.1 | UUAAUUUUAGAACACCUUUdTdT | 901 | A-138767.1 | AAAGGUGUUCUAAAAUUAAdTdT | 1152 |
| AD-69023.1 | A-138768.1 | ACACCUUUUUCACCUAACUdTdT | 902 | A-138769.1 | AGUUAGGUGAAAAAGGUGUdTdT | 1153 |
| AD-69024.1 | A-138770.1 | CCUAACUAAAAUAAUGUUUdTdT | 903 | A-138771.1 | AAACAUUAUUUUAGUUAGGdTdT | 1154 |
| AD-69025.1 | A-138772.1 | AUAAUGUUUAAAGAGUUUUdTdT | 904 | A-138773.1 | AAAACUCUUUAAACAUUAUdTdT | 1155 |
| AD-69026.1 | A-138774.1 | GAGUUUUGUAUAAAAUGUdTdT | 905 | A-138775.1 | ACAUUUUAUACAAAACUCdTdT | 1156 |
| AD-69027.1 | A-138776.1 | AAAAUGUAAGGAAGCGUUdTdT | 906 | A-138777.1 | AACGCUUCCUUACAUUUUdTdT | 1157 |
| AD-69028.1 | A-138778.1 | GGAAGCGUUGUUACCUGUUdTdT | 907 | A-138779.1 | AACAGGUAACAACGCUUCCdTdT | 1158 |
| AD-69029.1 | A-138780.1 | UACCUGUUGAAUUUUGUAUdTdT | 908 | A-138781.1 | AUACAAAAUUCAACAGGUAdTdT | 1159 |
| AD-69030.1 | A-138782.1 | UUGUAUUAUGUGAAUCAGUdTdT | 909 | A-138783.1 | ACUGAUUCACAUAAUACAAdTdT | 1160 |
| AD-69031.1 | A-138784.1 | GAAUCAGUGAGAUGUUAGUdTdT | 910 | A-138785.1 | ACUAACAUCUCACUGAUUCdTdT | 1161 |
| AD-69032.1 | A-138786.1 | AUGUUAGUAGAAUAAGCCUdTdT | 911 | A-138787.1 | AGGCUUAUUCUACUAACAUdTdT | 1162 |
| AD-69033.1 | A-138788.1 | AUAGCCUUAAAAAAAAAAdTdT | 912 | A-138789.1 | UUUUUUUUUUAAGGCUUAUdTdT | 1163 |
| AD-69034.1 | A-138790.1 | AAAAAAAAAAAAUCGGUUdTdT | 913 | A-138791.1 | AACCGAUUUUUUUUUUUUdTdT | 1164 |
| AD-69035.1 | A-138792.1 | AAUCGGUUGGGUGCAGUGAdTdT | 914 | A-138793.1 | UCACUGCACCCAACCGAUUdTdT | 1165 |
| AD-69036.1 | A-138794.1 | UGCAGUGGCACACGGCUGUdTdT | 915 | A-138795.1 | ACAGCCGUGUGCCACUGCAdTdT | 1166 |
| AD-69037.1 | A-138796.1 | GGCUGUAAUCCCAGCACUUdTdT | 916 | A-138797.1 | AAGUGCUGGGAUUACAGCCdTdT | 1167 |
| AD-69038.1 | A-138798.1 | CAGCACUUUGGGAGGCCAAdTdT | 917 | A-138799.1 | UUGGCCUCCCAAAGUGCUGdTdT | 1168 |
| AD-69039.1 | A-138800.1 | GAGGCCAAGGUUGGCAGAUdTdT | 918 | A-138801.1 | AUCUGCCAACCUUGGCCUCdTdT | 1169 |
| AD-69040.1 | A-138802.1 | UUGGCAGAUCACCUGAGGUdTdT | 919 | A-138803.1 | ACCUCAGGUGAUCUGCCAAdTdT | 1170 |
| AD-69041.1 | A-138804.1 | CUGAGGUCAGGAGUUCAAAdTdT | 920 | A-138805.1 | UUUGAACUCCUGACCUCAGdTdT | 1171 |
| AD-69042.1 | A-138806.1 | GAGUUCAAGACCAGUCUGAdTdT | 921 | A-138807.1 | UCAGACUGGUCUUGAACUCdTdT | 1172 |
| AD-69043.1 | A-138808.1 | CAGUCUGGCCAACAUAGCAdTdT | 922 | A-138809.1 | UGCUAUGUUGGCCAGACUGdTdT | 1173 |
| AD-69044.1 | A-138810.1 | AACAUAGCAAAACCCUGUAdTdT | 923 | A-138811.1 | UACAGGGUUUUGCUAUGUUdTdT | 1174 |
| AD-69045.1 | A-138812.1 | CCCUGUCUCUACUAAAAAUdTdT | 924 | A-138813.1 | AUUUUUAGUAGAGACAGGGdTdT | 1175 |
| AD-69046.1 | A-138814.1 | CUAAAAAUACAAAAAUUAUdTdT | 925 | A-138815.1 | AUAAUUUUUGUAUUUUUAGdTdT | 1176 |
| AD-69047.1 | A-138816.1 | AAAUUAUCUGGGCAUGGUdTdT | 926 | A-138817.1 | ACCAUGCCCAGAUAAUUUUdTdT | 1177 |
| AD-69048.1 | A-138818.1 | GGCAUGGUGGUGCAUGCCUdTdT | 927 | A-138819.1 | AGGCAUGCACCACCAUGCCdTdT | 1178 |
| AD-69049.1 | A-138820.1 | CAUGCCUGUAAUCCCAGCUdTdT | 928 | A-138821.1 | AGCUGGGAUUACAGGCAUGdTdT | 1179 |
| AD-69050.1 | A-138822.1 | AAUCCCAGCUAUUCGGAAAdTdT | 929 | A-138823.1 | UUUCCGAAUAGCUGGGAUUdTdT | 1180 |
| AD-69051.1 | A-138824.1 | UUCGGAAGGCUGAGGCAGAdTdT | 930 | A-138825.1 | UCUGCCUCAGCCUUCCGAAdTdT | 1181 |
| AD-69052.1 | A-138826.1 | AGGCAGGAGAAUCACUUGAdTdT | 931 | A-138827.1 | UCAAGUGAUUCUCCUGCCUdTdT | 1182 |

TABLE 5-continued

Modified Sense and Antisense Strand Sequences of PNPLA3 RNAi Agents

| Duplex Name | Sense Oligo Name | Sense Sequence (5'-3') | SEQ ID NO | Antisense Oligo Name | Antisense Sequence (5'-3') | SEQ ID NO |
|---|---|---|---|---|---|---|
| AD-69053.1 | A-138828.1 | AUCACUUGAACCCAGGAGAdTdT | 932 | A-138829.1 | UCUCCUGGGUUCAAGUGAUdTdT | 1183 |
| AD-69054.1 | A-138830.1 | CAGGAGGCGGAGGUUGCGAdTdT | 933 | A-138831.1 | UCGCAACCUCCGCCUCCUGdTdT | 1184 |
| AD-69055.1 | A-138832.1 | GUUGCGGUGAGCUGAGAUUdTdT | 934 | A-138833.1 | AAUCUCAGCUCACCGCAACdTdT | 1185 |
| AD-69056.1 | A-138834.1 | CUGAGAUUGCACCAUUUCAdTdT | 935 | A-138835.1 | UGAAAUGGUGCAAUCUCAGdTdT | 1186 |
| AD-69057.1 | A-138836.1 | CACCAUUUCAUUCCAGCCUdTdT | 936 | A-138837.1 | AGGCUGGAAUGAAAUGGUGdTdT | 1187 |
| AD-69058.1 | A-138838.1 | CAGCCUGGGCAACAUGAGUdTdT | 937 | A-138839.1 | ACUCAUGUUGCCCAGGCUGdTdT | 1188 |
| AD-69059.1 | A-138840.1 | AACAUGAGUGAAAGUCUGAdTdT | 938 | A-138841.1 | UCAGACUUUCACUCAUGUUdTdT | 1189 |
| AD-69060.1 | A-138842.1 | AGUCUGACUCAAAAAAAAAdTdT | 939 | A-138843.1 | UUUUUUUUGAGUCAGACUdTdT | 1190 |
| AD-69061.1 | A-138844.1 | AAAAAAAAAAAUUUAAAAdTdT | 940 | A-138845.1 | UUUUAAAUUUUUUUUUUUdTdT | 1191 |
| AD-69062.1 | A-138846.1 | UUUAAAAAACAAAAUAAUAdTdT | 941 | A-138847.1 | UAUUAUUUUGUUUUUAAAdTdT | 1192 |
| AD-69063.1 | A-138848.1 | AAAAUAAUCUAGUGUGCAAdTdT | 942 | A-138849.1 | UUGCACACUAGAUUAUUUdTdT | 1193 |
| AD-69064.1 | A-138850.1 | GUGUGCAGGGCAUUCACCUdTdT | 943 | A-138851.1 | AGGUGAAUGCCCUGCACACdTdT | 1194 |
| AD-69065.1 | A-138852.1 | CAUUCACCUCAGCCCCCCAdTdT | 944 | A-138853.1 | UGGGGGGCUGAGGUGAAUGdTdT | 1195 |
| AD-69066.1 | A-138854.1 | CCCCCAGGCAGGAGCCAAAdTdT | 945 | A-138855.1 | UUUGGCUCCUGCCUGGGGGdTdT | 1196 |
| AD-69067.1 | A-138856.1 | AGGAGCCAAGCACAGCAGAdTdT | 946 | A-138857.1 | UCUGCUGUGCUUGGCUCCUdTdT | 1197 |
| AD-69068.1 | A-138858.1 | ACAGCAGGAGCUUCCGCCUdTdT | 947 | A-138859.1 | AGGCGGAAGCUCCUGCUGUdTdT | 1198 |
| AD-69069.1 | A-138860.1 | UUCCGCCUCCUCUCCACUdTdT | 948 | A-138861.1 | UAGUGGAGAGGAGGCGGAAdTdT | 1199 |
| AD-69070.1 | A-138862.1 | UCCACUGGAGCACACAACUdTdT | 949 | A-138863.1 | AGUUGUGUGCUCCAGUGGAdTdT | 1200 |
| AD-69071.1 | A-138864.1 | ACACAACUUGAACCUGGCUdTdT | 950 | A-138865.1 | AGCCAGGUUCAAGUUGUGUdTdT | 1201 |
| AD-69072.1 | A-138866.1 | AACCUGGCUUAUUUUCUGAdTdT | 951 | A-138867.1 | UCAGAAAAUAAGCCAGGUUdTdT | 1202 |
| AD-69073.1 | A-138868.1 | UUCUGCAGGGACCAGCCCAdTdT | 952 | A-138869.1 | UGGGCUGGUCCCUGCAGAAdTdT | 1203 |
| AD-69074.1 | A-138870.1 | CCAGCCCCACAUGGUCAGUdTdT | 953 | A-138871.1 | ACUGACCAUGUGGGGCUGGdTdT | 1204 |
| AD-69076.1 | A-138874.1 | UUUCUCCCCAUGUGUGGCAdTdT | 954 | A-138875.1 | UGCCACACAUGGGGAGAAAdTdT | 1205 |
| AD-69077.1 | A-138878.1 | AGAGAGUGUAGAAAUAAAGdTdT | 955 | A-138879.1 | CUUUAUUUCUACACUCUCUdTdT | 1206 |

TABLE 6

PNPLA3 Single Dose Screen in Hep3B Cells
Data are expressed as percent message remaining relative to AD-1955, a non-targeting control duplex.

| Duplex Name | 20nM_AVG | 20nM_STDEV |
|---|---|---|
| AD-68792.1 | 106.53 | 9.20 |
| AD-68793.1 | 90.00 | 15.49 |
| AD-68794.1 | 55.08 | 11.00 |
| AD-68795.1 | 77.11 | 20.01 |
| AD-68796.1 | 71.27 | 7.67 |
| AD-68797.1 | 53.86 | 1.23 |
| AD-68798.1 | 76.58 | 29.01 |
| AD-68799.1 | 61.71 | 33.05 |
| AD-68800.1 | 84.27 | 23.89 |
| AD-68801.1 | 58.51 | 23.74 |
| AD-68802.1 | 48.71 | 3.47 |
| AD-68803.1 | 52.69 | 8.91 |
| AD-68804.1 | 56.10 | 9.15 |
| AD-68805.1 | 56.10 | 29.42 |
| AD-68806.1 | 52.09 | 4.59 |
| AD-68807.1 | 69.70 | 8.99 |
| AD-68808.1 | 83.88 | 7.42 |
| AD-68809.1 | 67.95 | 17.68 |
| AD-68810.1 | 52.56 | 22.52 |
| AD-68811.1 | 73.72 | 12.31 |
| AD-68812.1 | 70.61 | 22.53 |
| AD-68813.1 | 63.84 | 17.87 |
| AD-68814.1 | 56.57 | 4.47 |
| AD-68815.1 | 50.13 | 8.52 |
| AD-68816.1 | 91.97 | 18.35 |
| AD-68817.1 | 49.93 | 3.88 |
| AD-68818.1 | 74.08 | 23.36 |
| AD-68819.1 | 74.87 | 26.63 |
| AD-68820.1 | 59.47 | 18.45 |
| AD-68821.1 | 81.26 | 37.48 |

TABLE 6-continued

PNPLA3 Single Dose Screen in Hep3B Cells
Data are expressed as percent message remaining
relative to AD-1955, a non-targeting control duplex.

| Duplex Name | 20nM_AVG | 20nM_STDEV |
|---|---|---|
| AD-68822.1 | 63.53 | 8.85 |
| AD-68823.1 | 49.54 | 9.87 |
| AD-68824.1 | 87.65 | 12.09 |
| AD-68825.1 | 107.35 | 28.04 |
| AD-68826.1 | 100.30 | 41.14 |
| AD-68827.1 | 62.87 | 13.83 |
| AD-68828.1 | 63.50 | 18.27 |
| AD-68829.1 | 40.09 | 7.84 |
| AD-68830.1 | 32.34 | 4.08 |
| AD-68831.1 | 46.76 | 7.68 |
| AD-68832.1 | 78.43 | 16.54 |
| AD-68833.1 | 125.50 | 3.95 |
| AD-68834.1 | 112.62 | 6.58 |
| AD-68835.1 | 97.95 | 2.75 |
| AD-68836.1 | 117.74 | 52.61 |
| AD-68837.1 | 40.88 | 4.78 |
| AD-68838.1 | 91.56 | 20.60 |
| AD-68839.1 | 59.94 | 8.72 |
| AD-68840.1 | 79.60 | 5.47 |
| AD-68841.1 | 39.27 | 7.63 |
| AD-68842.1 | 88.01 | 18.52 |
| AD-68843.1 | 56.54 | 5.00 |
| AD-68844.1 | 51.39 | 10.45 |
| AD-68845.1 | 59.74 | 4.73 |
| AD-68846.1 | 54.54 | 14.99 |
| AD-68847.1 | 94.59 | 4.92 |
| AD-68848.1 | 92.93 | 14.62 |
| AD-68849.1 | 74.04 | 7.30 |
| AD-68850.1 | 110.43 | 16.00 |
| AD-68851.1 | 61.74 | 5.05 |
| AD-68852.1 | 63.66 | 21.55 |
| AD-68853.1 | 49.87 | 6.96 |
| AD-68854.1 | 47.59 | 6.65 |
| AD-68855.1 | 73.32 | 11.72 |
| AD-68856.1 | 106.96 | 18.30 |
| AD-68857.1 | 123.97 | 37.64 |
| AD-68858.1 | 60.42 | 4.02 |
| AD-68859.1 | 81.29 | 14.80 |
| AD-68860.1 | 68.06 | 17.18 |
| AD-68861.1 | 89.36 | 8.04 |
| AD-68862.1 | 62.20 | 19.06 |
| AD-68863.1 | 78.73 | 13.90 |
| AD-68864.1 | 71.54 | 10.06 |
| AD-68865.1 | 79.83 | 18.10 |
| AD-68866.1 | 90.56 | 9.37 |
| AD-68867.1 | 76.38 | 25.29 |
| AD-68868.1 | 106.98 | 9.34 |
| AD-68869.1 | 80.37 | 23.99 |
| AD-68870.1 | 62.13 | 19.67 |
| AD-68871.1 | 82.72 | 12.73 |
| AD-68872.1 | 78.95 | 8.19 |
| AD-68873.1 | 71.57 | 3.92 |
| AD-68874.1 | 118.98 | 25.63 |
| AD-68875.1 | 82.64 | 10.49 |
| AD-68876.1 | 106.02 | 17.93 |
| AD-68877.1 | 47.83 | 10.91 |
| AD-68878.1 | 68.77 | 9.18 |
| AD-68879.1 | 92.72 | 13.76 |
| AD-68880.1 | 121.48 | 13.92 |
| AD-68881.1 | 99.48 | 5.55 |
| AD-68882.1 | 90.81 | 8.65 |
| AD-68883.1 | 88.48 | 16.79 |
| AD-68884.1 | 126.40 | 27.97 |
| AD-68885.1 | 79.31 | 13.00 |
| AD-68905.1 | 59.11 | 11.11 |
| AD-68906.1 | 62.09 | 23.14 |
| AD-68907.1 | 91.47 | 18.05 |
| AD-68908.1 | 69.14 | 6.98 |
| AD-68909.1 | 57.61 | 0.00 |
| AD-68910.1 | 53.43 | 6.58 |
| AD-68911.1 | 49.21 | 4.14 |
| AD-68912.1 | 55.29 | 11.49 |
| AD-68913.1 | 60.30 | 3.64 |
| AD-68914.1 | 64.75 | 6.02 |
| AD-68915.1 | 77.72 | 5.80 |
| AD-68916.1 | 51.18 | 6.74 |
| AD-68917.1 | 61.47 | 5.86 |
| AD-68918.1 | 63.11 | 5.98 |
| AD-68919.1 | 58.34 | 10.77 |
| AD-68920.1 | 50.34 | 15.08 |
| AD-68921.1 | 82.27 | 16.34 |
| AD-68922.1 | 76.90 | 14.57 |
| AD-68923.1 | 73.35 | 4.56 |
| AD-68924.1 | 54.86 | 10.39 |
| AD-68925.1 | 79.75 | 12.87 |
| AD-68926.1 | 67.63 | 6.30 |
| AD-68927.1 | 70.30 | 11.39 |
| AD-68928.1 | 71.51 | 12.69 |
| AD-68929.1 | 66.30 | 18.72 |
| AD-68930.1 | 71.14 | 21.97 |
| AD-68931.1 | 71.05 | 8.92 |
| AD-68932.1 | 77.92 | 4.34 |
| AD-68933.1 | 101.43 | 16.21 |
| AD-68934.1 | 53.20 | 9.90 |
| AD-68935.1 | 99.51 | 9.41 |
| AD-68936.1 | 49.46 | 8.03 |
| AD-68937.1 | 57.51 | 13.53 |
| AD-68938.1 | 88.20 | 15.56 |
| AD-68939.1 | 74.32 | 14.17 |
| AD-68940.1 | 77.38 | 17.70 |
| AD-68941.1 | 76.90 | 11.02 |
| AD-68942.1 | 86.39 | 14.95 |
| AD-68943.1 | 110.51 | 36.72 |
| AD-68944.1 | 66.71 | 10.77 |
| AD-68945.1 | 70.73 | 19.44 |

Example 3. iRNA Synthesis

Source of Reagents

Where the source of a reagent is not specifically given herein, such reagent can be obtained from any supplier of reagents for molecular biology at a quality/purity standard for application in molecular biology.

Transcripts siRNA Design

A set of iRNAs targeting the human PNPLA3 (human: NCBI refseqID NM_025225; NCBI GeneID: 80339), as well as toxicology-species PNPLA3 orthologs (cynomolgus monkey: XM_005567051; mouse: NM_054088; rat: XM_006242109) were designed using custom R and Python scripts. The human PNPLA3 REFSEQ mRNA has a length of 2805 bases. The rationale and method for the set of iRNA designs is as follows: the predicted efficacy for every potential 19mer iRNA from position 174 through position 2805 (the coding region and 3' UTR) was determined with a linear model derived the direct measure of mRNA knockdown from more than 20,000 distinct iRNA designs targeting a large number of vertebrate genes. Subsets of the PNPLA3 iRNAs were designed with perfect or near-perfect matches between human and cynomolgus monkey. A further subset was designed with perfect or near-perfect matches to mouse and rat PNPLA3 orthologs. A further subset was designed with perfect or near-perfect matches to human, cynomolgus monkey, mouse, and rat PNPLA3 orthologs. For each strand of the iRNA, a custom Python script was used in a brute force search to measure the number and positions of mismatches between the iRNA and all potential alignments in the target species transcriptome. Extra weight was given to mismatches in the seed region, defined here as positions 2-9 of the antisense oligonucleotide, as well the cleavage site of the iRNA, defined here as positions 10-11 of the antisense oligonucleotide. The relative weight of the mismatches was 2.8, 1.2 and 1 for seed mismatches, cleavage site, and other positions up through antisense position 19, respectively. Mismatches in the first position were ignored. A specificity score was calculated for each strand by summing the value of each weighted mismatch. Preference was given to iRNAs whose antisense score in human and cynomolgus monkey was >=3.0 and predicted efficacy was >=70% knockdown of the PNPLA3 transcript.

A detailed list of the unmodified PNPLA3 sense and antisense strand sequences is shown in Table 7. A detailed list of the modified PNPLA3 sense and antisense strand sequences is shown in Table 8. Table 9 provides the mRNA target sequences of the modified PNPLA3 agents provided in Table 8

In Vitro Screening

Cell Culture and Transfections

Hep3b cells, mouse and cynomolgus monkey primary hepatocytes were transfected, independently, by adding 4.9 µl of Opti-MEM plus 0.1 µl of Lipofectamine RNAiMax per well (Invitrogen, Carlsbad Calif. cat #13778-150) to 5 µl of iRNA duplexes per well into a 384-well plate and incubated at room temperature for 15 minutes. Forty µl of EMEM containing about 5×10³ Hep3b cells, or 40 µl of William's media containing about 5×10³ primary mouse hepatocytes or primary cynomolgus monkey hepatocytes were then added to the iRNA mixture. Cells were incubated for 24 hours prior to RNA purification. Two single dose experiments were performed at 10 nM and 0.1 nM final duplex concentrations and dose response experiments were performed over a range of doses from 10 nM to 36 fM final duplex concentration over 8, 6-fold dilutions.

Total RNA Isolation Using DYNABEADS mRNA Isolation Kit

RNA was isolated using an automated protocol on a BioTek-EL406 platform using DYNABEAAs (Invitrogen, cat#61012). Briefly, 50 µl of Lysis/Binding Buffer and 25 µl of lysis buffer containing 3 µl of magnetic beads were added to the plate with cells. Plates were incubated on an electromagnetic shaker for 10 minutes at room temperature and then magnetic beads were captured and the supernatant was removed. Bead-bound RNA was then washed 2 times with 150 µl Wash Buffer A and once with Wash Buffer B. Beads were then washed with 150 µl Elution Buffer, re-captured and supernatant removed.

cDNA Synthesis Using ABI High Capacity cDNA Reverse Transcription Kit (Applied Biosystems, Foster City, Calif., Cat #4368813)

Ten µl of a master mix containing 1 µl 10× Buffer, 0.4 µl 25× dNTPs, 1 µl 10× Random primers, 0.5 µl Reverse Transcriptase, 0.5 µl RNase inhibitor and 6.6 µl of H2O per reaction was added to RNA isolated above. Plates were sealed, mixed, and incubated on an electromagnetic shaker for 10 minutes at room temperature, followed by 2 hours 37° C.

Real Time PCR

Two µl of cDNA were added to a master mix containing 0.5 µl of GAPDH TaqMan Probe (Hs99999905), 0.5 µl PNPLA3 probe and 5 µl Lightcycler 480 probe master mix (Roche Cat #04887301001) per well in a 384 well plates (Roche cat #04887301001). Hep3b qPCR was probed with GAPDH TaqMan Probe (Hs99999905) and PNPLA3 probe (Hs00228747_m1). Mouse primary hepatocytes qPCR was probed with Mouse GAPDH TaqMan Probe (Mm03302249_g1) and Mouse PNPLA3 Taqman Probe (Mm00504420_m1). Cynomolgus monkey primary hepatocytes qPCR was probed with custom Cynomolgus GAPDH probe and custom Cynomolgus PNPLA3 probe (5'-AGCGGGGUCUGAAGUCAU-3'(SEQ ID NO: 1207)). Real time PCR was done in a LightCycler480 Real Time PCR system (Roche) using the ΔΔCt(RQ) assay. Each duplex was tested in four independent transfections.

To calculate relative fold change, real time data were analyzed using the ΔΔCt method and normalized to assays performed with cells transfected with 20 nM AD-1955, a non-targeting control iRNA, or mock transfected cells. The sense and antisense sequences of AD-1955 are:

```
SENSE:
                             (SEQ ID NO: 1208)
cuuAcGcuGAGuAcuucGAdTsdT;

ANTISENSE:
                             (SEQ ID NO: 1209)
UCGAAGuACUcAGCGuAAGdTsdT.
```

In Vitro Dual-Glo® Screening

Cell Culture and Transfections

Cos7 cells (ATCC, Manassas, Va.) were grown to near confluence at 37° C. in an atmosphere of 5% CO2 in DMEM (ATCC) supplemented with 10% FBS, before being released from the plate by trypsinization. Dual-Glo® Luciferase constructs were generated in the psiCHECK2 plasmid and contained approximately 2.8 kb (human) PNPLA3 sequences (SEQ ID NO:18). Dual-luciferase plasmids were co-transfected with siRNA into 15×10³ cells using Lipofectamine RNAiMax (Invitrogen, Carlsbad Calif. cat #13778-150). For each well of a 96 well plate, 0.2 µl of Lipofectamine were added to 10 ng of plasmid vector and iRNA in 15 µl of Opti-MEM and allowed to complex at room temperature for 15 minutes. The mixture was then added to the cells resuspended in 80 µl of fresh complete media. Cells were incubated for 48 hours before luciferase was measured. Two single dose experiments were performed at 10 nM and 0.1 nM final duplex concentrations and dose response experiments were performed over a range of doses from 10 nM to 36 fM final duplex concentration over 8, 6-fold dilutions.

Dual-Glo® Luciferase Assay

Forty-eight hours after the siRNAs were transfected, Firefly (transfection control) and *Renilla* (fused to PNPLA3 target sequence in 3' UTR) luciferase were measured. First, media was removed from cells. Then Firefly luciferase activity was measured by adding 75 µl of Dual-Glo® Luciferase Reagent equal to the culture medium volume to each well and mix. The mixture was incubated at room temperature for 30 minutes before luminescense (500 nm) was measured on a Spectramax (Molecular Devices) to detect the Firefly luciferase signal. *Renilla* luciferase activity was measured by adding 75 µl of room temperature of Dual-Glo® Stop & Glo® Reagent to each well and the plates were incubated for 10-15 minutes before luminescence was again measured to determine the *Renilla* luciferase signal. The Dual-Glo® Stop & Glo® Reagent, quenches the firefly luciferase signal and sustained luminescence for the *Renilla* luciferase reaction. iRNA activity was determined by normalizing the *Renilla* (PNPLA3) signal to the Firefly (control) signal within each well. The magnitude of siRNA activity was then assessed relative to cells that were transfected with the same vector but were not treated with iRNA or were treated with a non-targeting iRNA. All transfections were done in triplicate.

Table 10 shows the results of a single 10 nM dose screen and a single 0.1 nM dose screen in Hep3B cells transfected with the indicated modified RNAi agents. Data are expressed as percent of message remaining relative to untreated cells.

Table 11 shows the results of a single 10 nM dose screen and a single 0.1 nM dose screen in Cynomolgus monkey primary hepatocytes transfected with the indicated modified RNAi agents. Data are expressed as percent of message remaining relative to untreated cells.

Table 12 shows the dose response in primary Cynomolgus monkey hepatocytes transfected with the indicated modified RNAi agents. The indicated $IC_{50}$ values represent the $IC_{50}$ values relative to untreated cells.

Table 13 shows the results of a single 10 nM dose screen and a single 0.1 nM dose screen in mouse primary hepatocytes transfected with the indicated modified RNAi agents. Data are expressed as percent of message remaining relative to untreated cells.

Table 14 shows the dose response in primary mouse hepatocytes transfected with the indicated modified RNAi agents. The indicated $IC_{50}$ values represent the $IC_{50}$ values relative to untreated cells.

Table 15 shows the results of a single 10 nM dose screen and a single 0.1 nM dose screen in Cos7 cells transfected with the indicated modified PNPLA3 RNAi agents. Data are expressed as percent of mRNA remaining relative to negative control.

Table 16 shows the dose response in Cos7 cells transfected with the indicated modified RNAi agents. The indicated $IC_{50}$ values represent the $IC_{50}$ values relative to untreated cells.

TABLE 7

PNPLA3 Unmodified Sequences

| Duplex Name | Sense Oligo Name | Sense Sequence 5' to 3' | SEQ ID NO | Start in SEQ ID NO: 1 | Antisense Oligo Name | Antisense Sequence 5' to 3' | SEQ ID NO | Start in SEQ ID NO: 1 | Range |
|---|---|---|---|---|---|---|---|---|---|
| AD-67524.1 | A-135231.1 | GGCUUCCUGGGCUUCUACCAA | 1210 | 219 | A-135232.1 | UUGGUAGAAGCCCAGGAAGCCGC | 1300 | 217 | 217-239 |
| AD-67611.1 | A-135409.1 | UUGUGCGGAAGGCCAGGAGUA | 1211 | 388 | A-135410.1 | UACUCCUGGCCUUCCGCACAAGA | 1301 | 386 | 386-408 |
| AD-67601.1 | A-135389.1 | AAGGCCAGGAGUCGGAACAUU | 1212 | 396 | A-135390.1 | AAUGUUCCGACUCCUGGCCUUCC | 1302 | 394 | 394-416 |
| AD-67579.1 | A-135341.1 | AGGCCAGGAGUCGGAACAUUA | 1213 | 397 | A-135342.1 | UAAUGUUCCGACUCCUGGCCUUC | 1303 | 395 | 395-417 |
| AD-67588.1 | A-135361.1 | AACGUCUGGUGUCUGACUUU | 1214 | 549 | A-135362.1 | AAAGUCAGACACCAGAACGUUUU | 1304 | 547 | 547-569 |
| AD-67602.1 | A-135391.1 | CUGACUUUCGGUCCAAAGACA | 1215 | 562 | A-135392.1 | UGUCUUUGGACCGAAAGUCAGAC | 1305 | 560 | 560-582 |
| AD-67570.1 | A-135323.1 | UCGGUCCAAAGACGAAGUCGU | 1216 | 569 | A-135324.1 | ACGACUUCGUCUUUGGACCGAAA | 1306 | 567 | 567-589 |
| AD-67553.1 | A-135289.1 | CGGUCCAAAGACGAAGUCGUA | 1217 | 570 | A-135290.1 | UACGACUUCGUCUUUGGACCGAA | 1307 | 568 | 568-590 |
| AD-67612.1 | A-135411.1 | GACGAAGUCGUGAUGCCUUA | 1218 | 579 | A-135412.1 | UAAGGCAUCCACGACUUCGUCUU | 1308 | 577 | 577-599 |
| AD-67525.1 | A-135233.1 | CUUGGUAUGUUCCUGCUUCAU | 1219 | 596 | A-135234.1 | AUGAAGCAGGAACAUACCAAGGC | 1309 | 594 | 594-616 |
| AD-67526.1 | A-135235.1 | GGCCUUAUCCCCUCCUUCCUUA | 1220 | 630 | A-135236.1 | UAAGGAAGGAGGGAUAAGGCCAC | 1310 | 628 | 628-650 |
| AD-67592.1 | A-135371.1 | AGGAGUGAGUGACAAACGUACA | 1221 | 674 | A-135372.1 | UGUACGUUUGUCACUCACUCCUCC | 1311 | 672 | 672-694 |
| AD-67578.1 | A-135339.1 | GUGAGUGACAAACGUACCCUUA | 1222 | 678 | A-135340.1 | UAAGGGUACGUUUGUCACUCACUC | 1312 | 676 | 676-698 |
| AD-67555.1 | A-135293.1 | UGAUGCCAAAACAACCAUCAA | 1223 | 701 | A-135294.1 | UUGAUGGUUGUUUUGGCAUCAAU | 1313 | 699 | 699-721 |
| AD-67577.1 | A-135337.1 | CGACAUCUGCCCUAAAGUCAA | 1224 | 746 | A-135338.1 | UUGACUUUAGGGCAGAUGUCGUA | 1314 | 744 | 744-766 |
| AD-67594.1 | A-135375.1 | ACGAACUUUCUUCAUGUGGAA | 1225 | 771 | A-135376.1 | UUCCACAUGAAGAAAGUUCGUGG | 1315 | 769 | 769-791 |
| AD-67568.1 | A-135319.1 | GCACAGGGAACCUCCUACCUUA | 1226 | 817 | A-135320.1 | UAAGGUAGAGGUUCCCUGUGCAG | 1316 | 815 | 815-837 |
| AD-67550.1 | A-135283.1 | UGCUGGGAGAGAUAUGCCUUA | 1227 | 871 | A-135284.1 | UAAGGCAUAUCUCUCCCAGCACC | 1317 | 869 | 869-891 |
| AD-67586.1 | A-135357.1 | UGGGAGAGAUAUGCCUUCGAA | 1228 | 874 | A-135358.1 | UUCGAAGGCAUAUCUCUCCCAGC | 1318 | 872 | 872-894 |
| AD-67576.1 | A-135335.1 | AGAGAUAUGCCUUCGAGGAUA | 1229 | 878 | A-135336.1 | UAUCCUCGAAGGCAUAUCUCUCC | 1319 | 876 | 876-898 |
| AD-67563.1 | A-135309.1 | AUAUGCCUUCGAGGAUAUUUA | 1230 | 882 | A-135310.1 | UAAAUAUCCUCGAAGGCAUAUCU | 1320 | 880 | 880-902 |
| AD-67552.1 | A-135287.1 | UGCCUUCGAGGAUAUUUGGAU | 1231 | 885 | A-135288.1 | AUCCAAAUAUCCUCGAAGGCAUA | 1321 | 883 | 883-905 |
| AD-67608.1 | A-135403.1 | AUUCAGGUUCUUGGAAGAGAA | 1232 | 908 | A-135404.1 | UUCUCUUCCAAGAACCUGAAUGC | 1322 | 906 | 906-928 |

TABLE 7-continued

PNPLA3 Unmodified Sequences

| Duplex Name | Sense Oligo Name | Sense Sequence 5' to 3' | SEQ ID NO | Start in SEQ ID NO: 1 | Antisense Oligo Name | Antisense Sequence 5' to 3' | SEQ ID NO | Start in SEQ ID NO: 1 | Range |
|---|---|---|---|---|---|---|---|---|---|
| AD-67593.1 | A-135373.1 | CAUCCUCAGAAGGAUGGAUA | 1233 | 964 | A-135374.1 | UAUCCAUCCCUCUGAGGAUGAC | 1323 | 962 | 962-984 |
| AD-67609.1 | A-135405.1 | CCUGCCCUGGGAUGAGAGCAU | 1234 | 1100 | A-135406.1 | AUGCUCUCAUCCCAGGGCAGGAU | 1324 | 1098 | 1098-1120 |
| AD-67597.1 | A-135381.1 | GACAAAGGUGGAUACAUGAGA | 1235 | 1173 | A-135382.1 | UCUCAUGUAUCCACCUUUGUCUU | 1325 | 1171 | 1171-1193 |
| AD-67587.1 | A-135359.1 | AAAGGUGGAUACAUGAGCAAA | 1236 | 1176 | A-135360.1 | UUUGCUCAUGUAUCCACCUUUGU | 1326 | 1174 | 1174-1196 |
| AD-67559.1 | A-135301.1 | GUGGAUACAUGAGCAAGAUUU | 1237 | 1180 | A-135302.1 | AAAUCUUGCUCAUGUAUCCACCU | 1327 | 1178 | 1178-1200 |
| AD-67561.1 | A-135305.1 | UGGAUACAUGAGCAAGAUUUA | 1238 | 1181 | A-135306.1 | UAAAUCUUGCUCAUGUAUCCACC | 1328 | 1179 | 1179-1201 |
| AD-67551.1 | A-135285.1 | AUACAUGAGCAAGAUUUGCAA | 1239 | 1184 | A-135286.1 | UUGCAAAUCUUGCUCAUGUAUCC | 1329 | 1182 | 1182-1204 |
| AD-67591.1 | A-135369.1 | AGCAAGAUUUGCAACUUGCUA | 1240 | 1191 | A-135370.1 | UAGCAAGUUGCAAAUCUUGCUCA | 1330 | 1189 | 1189-1211 |
| AD-67583.1 | A-135351.1 | CAAGAUUUGCAACUUGCUACA | 1241 | 1193 | A-135352.1 | UGUAGCAAGUUGCAAAUCUUGCU | 1331 | 1191 | 1191-1213 |
| AD-67585.1 | A-135355.1 | UGCAACUUGCUACCAUUAGA | 1242 | 1200 | A-135356.1 | UCUAAUGGUAGCAAGUUGCAAA | 1332 | 1198 | 1198-1220 |
| AD-67589.1 | A-135363.1 | AACUUGCUACCCAUUAUAGGAUA | 1243 | 1203 | A-135364.1 | UAUCCUAAUGGUAGCAAGUUGC | 1333 | 1201 | 1201-1223 |
| AD-67595.1 | A-135377.1 | GCCAUUGCGAUUGUCCAGAGA | 1244 | 1266 | A-135378.1 | UCUCUGGACAAUCGCAAUGGCAG | 1334 | 1264 | 1264-1286 |
| AD-67580.1 | A-135343.1 | GAUUGUCCAGAGACUGGUGAA | 1245 | 1274 | A-135344.1 | UUCACCAGUCUCUGGACAAUCGC | 1335 | 1272 | 1272-1294 |
| AD-67573.1 | A-135329.1 | UGGAGACAUGGCUUCCAGAUA | 1246 | 1288 | A-135330.1 | UAUCUGGAAGCCAUGUCACCAGU | 1336 | 1286 | 1286-1308 |
| AD-67600.1 | A-135387.1 | CCAGAUAUGCCCGACGAUGUA | 1247 | 1302 | A-135388.1 | UACAUCGUCGGGCAUAUCUGGAA | 1337 | 1300 | 1300-1322 |
| AD-67603.1 | A-135393.1 | GUGGUUGCAGUGGUGACCUA | 1248 | 1325 | A-135394.1 | UAGGUCACCACUGCAACCACAG | 1338 | 1323 | 1323-1345 |
| AD-67598.1 | A-135383.1 | AGGUCCCAAAUGCCAGUGAGA | 1249 | 1389 | A-135384.1 | UCUCACUGGCAUUUGGGACCUGG | 1339 | 1387 | 1387-1409 |
| AD-67564.1 | A-135311.1 | UCACUGAGAGGCGAGUCUA | 1250 | 1621 | A-135312.1 | UAGACUCGCCUCUCAGUGACU | 1340 | 1619 | 1619-1641 |
| AD-67574.1 | A-135331.1 | AGUCUAGCAGAAUCUUUCAGA | 1251 | 1636 | A-135332.1 | UCUGAAAGAAUCUGCUAGACUCG | 1341 | 1634 | 1634-1656 |
| AD-67590.1 | A-135365.1 | AUUCUUUCAGAGGUGCUAAAA | 1252 | 1646 | A-135366.1 | UUUUAGCACCUCUGAAAGAAUCU | 1342 | 1644 | 1644-1666 |
| AD-67572.1 | A-135327.1 | UUCUUUCAGAGGUGCUAAAGU | 1253 | 1647 | A-135328.1 | ACUUUAGCACCUCUGAAAGAAUC | 1343 | 1645 | 1645-1667 |
| AD-67582.1 | A-135349.1 | GUGCUAAAGUUUCCCAUCUUU | 1254 | 1658 | A-135350.1 | AAAGAUGGGAAACUUUAGCACCU | 1344 | 1656 | 1656-1678 |
| AD-67607.1 | A-135401.1 | UCCCAUCUUUGUGCAGCUACA | 1255 | 1669 | A-135402.1 | UGUAGCUGCACAAAGAUGGGAAA | 1345 | 1667 | 1667-1689 |
| AD-67571.1 | A-135325.1 | CUGCCUGACGUGGAGGAUA | 1256 | 1713 | A-135326.1 | UAUCCUCCACGUCAGGCAGGG | 1346 | 1711 | 1711-1733 |

TABLE 7-continued

PNPLA3 Unmodified Sequences

| Duplex Name | Sense Oligo Name | Sense Sequence 5' to 3' | SEQ ID NO | Start in SEQ ID NO: 1 | Antisense Oligo Name | Antisense Sequence 5' to 3' | SEQ ID NO | Start in SEQ ID NO: 1 | Range |
|---|---|---|---|---|---|---|---|---|---|
| AD-67599.1 | A-135385.1 | UGUGACGUGGAGGAUCCAGA | 1257 | 1718 | A-135386.1 | UCUGGGAUCCUCCACGUCACAGG | 1347 | 1716 | 1716-1738 |
| AD-67554.1 | A-135291.1 | UCUGAGCUGAGUUGGUUUUAU | 1258 | 1740 | A-135292.1 | AUAAAACCAACUCAGCUCAGAGG | 1348 | 1738 | 1738-1760 |
| AD-67549.1 | A-135281.1 | AGUUGGUUUUAUGAAAAGCUA | 1259 | 1749 | A-135282.1 | UAGCUUUUCAUAAAACCAACUCA | 1349 | 1747 | 1747-1769 |
| AD-67567.1 | A-135317.1 | UUGGUUUUAUGAAAAGCUAGA | 1260 | 1751 | A-135318.1 | UCUAGCUUUUCAUAAAACCAACU | 1350 | 1749 | 1749-1771 |
| AD-67558.1 | A-135299.1 | GGUUUUAUGAAAAGCUAGGAA | 1261 | 1753 | A-135300.1 | UUCCUAGCUUUUCAUAAAACCAA | 1351 | 1751 | 1751-1773 |
| AD-67569.1 | A-135321.1 | GUUUUAUGAAAAGCUAGGAAA | 1262 | 1754 | A-135322.1 | UUUCCUAGCUUUUCAUAAAACCA | 1352 | 1752 | 1752-1774 |
| AD-67548.1 | A-135279.1 | UUUUAUGAAAAGCUAGGAAGA | 1263 | 1755 | A-135280.1 | UCUUCCUAGCUUUUCAUAAAACC | 1353 | 1753 | 1753-1775 |
| AD-67566.1 | A-135315.1 | UAUGAAAAGCUAGGAAGCAAA | 1264 | 1758 | A-135316.1 | UUUGCUUCCUAGCUUUUCAUAAA | 1354 | 1756 | 1756-1778 |
| AD-67613.1 | A-135413.1 | CGUUAAUUCAGCUGGUUGGGA | 1265 | 1827 | A-135414.1 | UCCCAACCAGCUGAAUUAACGCA | 1355 | 1825 | 1825-1847 |
| AD-67610.1 | A-135407.1 | GUUAAUUCAGCUGGUUGGGAA | 1266 | 1828 | A-135408.1 | UUCCCAACCAGCUGAAUUAACGC | 1356 | 1826 | 1826-1848 |
| AD-67556.1 | A-135295.1 | AGCUGGUUGGGAAAUGACACA | 1267 | 1836 | A-135296.1 | UGUGUCAUUUCCCAACCAGCUGA | 1357 | 1834 | 1834-1856 |
| AD-67581.1 | A-135345.1 | CCUAUUAAUGGUCAGACUGUU | 1268 | 1900 | A-135346.1 | AACAGUCUGACCAUUAAUAGGGC | 1358 | 1898 | 1898-1920 |
| AD-67560.1 | A-135303.1 | CUAUUAAUGGUCAGACUGUUA | 1269 | 1901 | A-135304.1 | UAACAGUCUGACCAUUAAUAGGG | 1359 | 1899 | 1899-1921 |
| AD-67596.1 | A-135379.1 | GCUGCCCAUGUGAUCGAUCUUA | 1270 | 1984 | A-135380.1 | UAAGAUCACACAUGGGCCAGCCU | 1360 | 1982 | 1982-2004 |
| AD-67557.1 | A-135297.1 | UGGCCCAUGUGAUCGAUCUGUA | 1271 | 1986 | A-135298.1 | UACAAGAUCACACAUGGGCCAGC | 1361 | 1984 | 1984-2006 |
| AD-67584.1 | A-135353.1 | CCUAACUAAAAUAAUGUUUAA | 1272 | 2190 | A-135354.1 | UUAAAACAUUAUUUUAGUAGGUG | 1362 | 2188 | 2188-2210 |
| AD-67575.1 | A-135333.1 | UUACCUGUUGAAUUUGUAUU | 1273 | 2243 | A-135334.1 | AAUACAAAAUUCAACAGGUAACA | 1363 | 2241 | 2241-2263 |
| AD-67605.1 | A-135397.1 | ACCUGUUGAAUUUGUAUAU | 1274 | 2245 | A-135398.1 | AUAUAUACAAAAUUCAACAGGUAA | 1364 | 2243 | 2243-2265 |
| AD-67562.1 | A-135307.1 | UGUAUUAUGUGAUCAGUGAA | 1275 | 2258 | A-135308.1 | UUCACUGAUCACAUAAUAACAAA | 1365 | 2256 | 2256-2278 |
| AD-67606.1 | A-135399.1 | UAUGUUAGUCAGUGAGAUGUU | 1276 | 2263 | A-135400.1 | AACAUCUCACUGAUUCACAUAAU | 1366 | 2261 | 2261-2283 |
| AD-67604.1 | A-135395.1 | GAUGUUAGUAGAAUAAGCCUU | 1277 | 2278 | A-135396.1 | AAGGCUUAUUCUACUAACAUCUC | 1367 | 2276 | 2276-2298 |
| AD-67565.1 | A-135313.1 | AUGUUAGUAGAAUAAGCCUUA | 1278 | 2279 | A-135314.1 | UAAGGCUUAUUCUACUAACAUCU | 1368 | 2277 | 2277-2299 |
| AD-67529.1 | A-135241.1 | UAUAAUGGAGAUCCUCAUGGA | 1279 | 250 | A-135242.1 | UCCAUGAGGAUCUCCAUUAUACG | 1369 | 248 | 248-270 |
| AD-67533.1 | A-135249.1 | GUGUCUGAGUUCCAUCCAAA | 1280 | 443 | A-135250.1 | UUUGGAAUGGAACUCAGACACCA | 1370 | 441 | 441-463 |

TABLE 7-continued

PNPLA3 Unmodified Sequences

| Duplex Name | Sense Oligo Name | Sense Sequence 5' to 3' | SEQ ID NO | Start in SEQ ID NO: 1 | Antisense Oligo Name | Antisense Sequence 5' to 3' | SEQ ID NO | Start in SEQ ID NO: 1 | Range |
|---|---|---|---|---|---|---|---|---|---|
| AD-67537.1 | A-135257.1 | AGUCGUGGAUGCCCUGGUGUA | 1281 | 469 | A-135258.1 | UACACCAGGGCAUCCACGACUUC | 1371 | 467 | 467-489 |
| AD-67546.1 | A-135275.1 | UGCUAUCAAGGUACCUGGAA | 1282 | 770 | A-135276.1 | UUCCAGGUACCCUUGAUAGCACA | 1372 | 768 | 768-790 |
| AD-67547.1 | A-135277.1 | UCCCAGGUUUGUGCCCGAAUA | 1283 | 1163 | A-135278.1 | UAUUCGGGCACAAACCUGGAUG | 1373 | 1161 | 1161-1183 |
| AD-67543.1 | A-135269.1 | CCAGGUUUGUGCCCGAAUGA | 1284 | 1165 | A-135270.1 | UUCAUUCGGGCACAAACCUGGGA | 1374 | 1163 | 1163-1185 |
| AD-67541.1 | A-135265.1 | UGGAGCAACAGUGUCUAGAUA | 1285 | 3032 | A-135266.1 | UAUCUAGACACUGUUGCUCCAGA | 1375 | 3030 | 3030-3052 |
| AD-67535.1 | A-135253.1 | CUUUUGGAGGCAGCUAGGAAA | 1286 | 3106 | A-135254.1 | UUUCCUAGCUGCCUCCAAAAGUA | 1376 | 3104 | 3104-3126 |
| AD-67530.1 | A-135243.1 | AAGACAAUGAUUUGGUGUUUA | 1287 | 3226 | A-135244.1 | UAAACACCAAAUCAUUGUCUUUG | 1377 | 3224 | 3224-3246 |
| AD-67542.1 | A-135267.1 | GACAAUGAUUUGGUGUUUAGA | 1288 | 3228 | A-135268.1 | UCUAAACACCAAAUCAUUGUCUU | 1378 | 3226 | 3226-3248 |
| AD-67528.1 | A-135239.1 | CAAUGAUUUGGUGUUUAGAAA | 1289 | 3230 | A-135240.1 | UUUCUAAACACCAAAUCAUUGUC | 1379 | 3228 | 3228-3250 |
| AD-67527.1 | A-135237.1 | UGCCAGAACUAAUCUAUUACUUU | 1290 | 3447 | A-135238.1 | AAAGUAAUAAGUUAUCUGGCAGG | 1380 | 3445 | 3445-3467 |
| AD-67544.1 | A-135271.1 | ACACCUUUGGCUCUACUAAU | 1291 | 3473 | A-135272.1 | AUUAGUAGAGCCAAAGUGUCC | 1381 | 3471 | 3471-3493 |
| AD-67532.1 | A-135247.1 | CUGGCUCCAAAUCUUUGUAUA | 1292 | 3629 | A-135248.1 | UAUACAAAGAUUUGGAGCCAGUG | 1382 | 3627 | 3627-3649 |
| AD-67534.1 | A-135251.1 | UGGCUCCAAAUCUUUGUAUAA | 1293 | 3630 | A-135252.1 | UUAUACAAAGAUUUGGAGCCAGU | 1383 | 3628 | 3628-3650 |
| AD-67538.1 | A-135259.1 | CCAAAUCUUUGUAUAGUCAUA | 1294 | 3635 | A-135260.1 | UAUGACUAUACAAAGAUUUGGAG | 1384 | 3633 | 3633-3655 |
| AD-67545.1 | A-135273.1 | AGAGACAAAGUGUCUAGGCUA | 1295 | 3986 | A-135274.1 | UAGCCUAGACACUUUGUCUCUAG | 1385 | 3984 | 3984-4006 |
| AD-67539.1 | A-135261.1 | AAGUGUCUAGGCUACACAGAA | 1296 | 3993 | A-135262.1 | UUCUGUGUAGCCUAGACACUUUG | 1386 | 3991 | 3991-4013 |
| AD-67540.1 | A-135263.1 | AGAAACUUCUGCCUUGCUUUA | 1297 | 4283 | A-135264.1 | UAAAGCAAGGCAGAAGUUCUAC | 1387 | 4281 | 4281-4303 |
| AD-67531.1 | A-135245.1 | GAAGGAUUGAAUGGAUACACA | 1298 | 4540 | A-135246.1 | UGUGUAUCCAUUCAAUCCUUCUG | 1388 | 4538 | 4538-4560 |
| AD-67536.1 | A-135255.1 | GGAUUGAAUGGAUACACCAAA | 1299 | 4543 | A-135256.1 | UUUGGUGUAUCCAUUCAAUCCUU | 1389 | 4541 | 4541-4563 |

TABLE 8

PNPLA3 Modified Sequences

| Duplex Name | Sense Oligo Name | Sense Sequence 5' to 3' | SEQ ID NO |
|---|---|---|---|
| AD-67524.1 | A-135231.1 | gsgscuucCfuGfGfGfcuucuaccaaL96 | 1390 |
| AD-67611.1 | A-135409.1 | ususgugcGfgAfAfGfgccaggaguaL96 | 1391 |
| AD-67601.1 | A-135389.1 | asasggccAfgGfAfGfucggaacauuL96 | 1392 |
| AD-67579.1 | A-135341.1 | asgsgccaGfgAfGfUfcggaacauuaL96 | 1393 |
| AD-67588.1 | A-135361.1 | asascguuCfuGfGfGfUfgucugacuuuL96 | 1394 |
| AD-67602.1 | A-135391.1 | csusgacuUfuCfGfGfuccaaagacaL96 | 1395 |
| AD-67570.1 | A-135323.1 | uscsggucCfaAfAfGfacgaagucguL96 | 1396 |
| AD-67553.1 | A-135289.1 | csgsguccAfaAfGfAfcgaagucguaL96 | 1397 |
| AD-67612.1 | A-135411.1 | gsascgaaGfuCfGfUfggaugccuuaL96 | 1398 |
| AD-67525.1 | A-135233.1 | csusugguAfuGfUfUfccugcuucauL96 | 1399 |
| AD-67526.1 | A-135235.1 | gsgsccuuAfuCfCfCfuccuuccuuaL96 | 1400 |
| AD-67592.1 | A-135371.1 | asgsgaguGfaGfUfGfacaacguacaL96 | 1401 |
| AD-67578.1 | A-135339.1 | gsusgaguGfaCfAfAfcguacccuuaL96 | 1402 |
| AD-67555.1 | A-135293.1 | usgsaugcCfaAfAfAfcaaccaucaaL96 | 1403 |
| AD-67577.1 | A-135337.1 | csgsacauCfuGfCfCfcuaaagucaaL96 | 1404 |
| AD-67594.1 | A-135375.1 | ascsgaacUfuUfCfUfucaugugaaL96 | 1405 |
| AD-67568.1 | A-135319.1 | gscsacagGfgAfAfCfcucuaccuuaL96 | 1406 |
| AD-67550.1 | A-135283.1 | usgscuggGfaGfAfGfauaugccuuaL96 | 1407 |
| AD-67586.1 | A-135357.1 | usgsggagAfgAfUfAfugccuucgaaL96 | 1408 |
| AD-67576.1 | A-135335.1 | asgsagauAfuGfCfCfuucgaggauaL96 | 1409 |
| AD-67563.1 | A-135309.1 | asusaugcCfuUfCfGfaggauauuuaL96 | 1410 |
| AD-67552.1 | A-135287.1 | usgsccuuCfgAfGfGfauauuuggauL96 | 1411 |
| AD-67608.1 | A-135403.1 | asusucagGfuUfCfUfuggaagagaaL96 | 1412 |
| AD-67593.1 | A-135373.1 | csasuccuCfaGfAfAfgggaugauaL96 | 1413 |
| AD-67609.1 | A-135405.1 | cscsugccCfuGfGfGfaugagagcauL96 | 1414 |
| AD-67597.1 | A-135381.1 | gsascaaaGfgUfGfGfauacaugagaL96 | 1415 |
| AD-67587.1 | A-135359.1 | asasagguGfgAfUfAfcaugagcaaaL96 | 1416 |
| AD-67559.1 | A-135301.1 | gsusggauAfcAfUfGfagcaagauuuL96 | 1417 |
| AD-67561.1 | A-135305.1 | usgsgauaCfaUfGfAfgcaagauuuaL96 | 1418 |
| AD-67551.1 | A-135285.1 | asusacauGfaGfCfAfagauuugcaaL96 | 1419 |
| AD-67591.1 | A-135369.1 | asgscaagAfuUfUfGfcaacuugcuaL96 | 1420 |
| AD-67583.1 | A-135351.1 | csasagauUfuGfCfAfacuugcuacaL96 | 1421 |
| AD-67585.1 | A-135355.1 | usgscaacUfuGfCfUfacccauuagaL96 | 1422 |
| AD-67589.1 | A-135363.1 | asascuugCfuAfCfCfcauuaggauaL96 | 1423 |
| AD-67595.1 | A-135377.1 | gscscauuGfcGfAfUfuguccagagaL96 | 1424 |
| AD-67580.1 | A-135343.1 | gsasuuguCfcAfGfAfgacuggugaaL96 | 1425 |
| AD-67573.1 | A-135329.1 | usgsgugaCfaUfGfGfcuuccagauaL96 | 1426 |
| AD-67600.1 | A-135387.1 | cscsagauAfuGfCfCfcgacgauguaL96 | 1427 |

TABLE 8-continued

| PNPLA3 Modified Sequences | | | |
|---|---|---|---|
| AD-67603.1 | A-135393.1 | gsusgguuGfcAfGfUfgggugaccuaL96 | 1428 |
| AD-67598.1 | A-135383.1 | asgsguccCfaAfAfUfgccagugagaL96 | 1429 |
| AD-67564.1 | A-135311.1 | uscsacuuGfaGfGfAfggcgagucuaL96 | 1430 |
| AD-67574.1 | A-135331.1 | asgsucuaGfcAfGfAfuucuuucagaL96 | 1431 |
| AD-67590.1 | A-135365.1 | asusucuuUfcAfGfAfggugcuaaaaL96 | 1432 |
| AD-67572.1 | A-135327.1 | ususcuuuCfaGfAfGfgugcuaaaguL96 | 1433 |
| AD-67582.1 | A-135349.1 | gsusgcuaAfaGfUfUfucccaucuuuL96 | 1434 |
| AD-67607.1 | A-135401.1 | uscsccauCfuUfUfGfugcagcuacaL96 | 1435 |
| AD-67571.1 | A-135325.1 | csusgccuGfuGfAfCfguggaggauaL96 | 1436 |
| AD-67599.1 | A-135385.1 | usgsugacGfuGfGfAfggaucccagaL96 | 1437 |
| AD-67554.1 | A-135291.1 | uscsugagCfuGfAfGfuugguuuuauL96 | 1438 |
| AD-67549.1 | A-135281.1 | asgsuuggUfuUfUfAfugaaaagcuaL96 | 1439 |
| AD-67567.1 | A-135317.1 | ususgguuUfuAfUfGfaaaagcuagaL96 | 1440 |
| AD-67558.1 | A-135299.1 | gsgsuuuuAfuGfAfAfaagcuaggaaL96 | 1441 |
| AD-67569.1 | A-135321.1 | gsusuuuaUfgAfAfAfagcuaggaaaL96 | 1442 |
| AD-67548.1 | A-135279.1 | ususuuauGfaAfAfAfgcuaggaagaL96 | 1443 |
| AD-67566.1 | A-135315.1 | usasugaaAfaGfCfUfaggaagcaaaL96 | 1444 |
| AD-67613.1 | A-135413.1 | csgsuuaaUfuCfAfGfcugguugggaL96 | 1445 |
| AD-67610.1 | A-135407.1 | gsusuaauUfcAfGfCfugguugggaaL96 | 1446 |
| AD-67556.1 | A-135295.1 | asgscuggUfuGfGfGfaaaugacacaL96 | 1447 |
| AD-67581.1 | A-135345.1 | cscsuauuAfaUfGfGfucagacuguuL96 | 1448 |
| AD-67560.1 | A-135303.1 | csusauuaAfuGfGfUfcagacuguuaL96 | 1449 |
| AD-67596.1 | A-135379.1 | gscsuggcCfcAfUfGfugugaucuuaL96 | 1450 |
| AD-67557.1 | A-135297.1 | usgsgcccAfuGfUfGfugaucuuguaL96 | 1451 |
| AD-67584.1 | A-135353.1 | cscsuaacUfaAfAfAfuaauguuuaaL96 | 1452 |
| AD-67575.1 | A-135333.1 | ususaccuGfuUfGfAfauuuuguauuL96 | 1453 |
| AD-67605.1 | A-135397.1 | ascscuguUfgAfAfUfuuuuguauuaL96 | 1454 |
| AD-67562.1 | A-135307.1 | usgsuauuAfuGfUfUfgaaucagugaL96 | 1455 |
| AD-67606.1 | A-135399.1 | usasugugAfaUfCfAfgugagauguuL96 | 1456 |
| AD-67604.1 | A-135395.1 | gsasuguuAfgUfAfGfaauaagccuuL96 | 1457 |
| AD-67565.1 | A-135313.1 | asusguuaGfuAfGfAfauaagccuuaL96 | 1458 |
| AD-67529.1 | A-135241.1 | usasuaauGfgAfGfAfuccucauggaL96 | 1459 |
| AD-67533.1 | A-135249.1 | gsusgucuGfaGfUfUfccauuccaaaL96 | 1460 |
| AD-67537.1 | A-135257.1 | asgsucguGfgAfUfGfcccuggguuaL96 | 1461 |
| AD-67546.1 | A-135275.1 | usgscuauCfaAfGfGfguaccuggaaL96 | 1462 |
| AD-67547.1 | A-135277.1 | uscsccagGfuUfUfGfugcccgaauaL96 | 1463 |
| AD-67543.1 | A-135269.1 | cscsagguUfuGfUfGfcccgaaugaaL96 | 1464 |
| AD-67541.1 | A-135265.1 | usgsgagcAfaCfAfGfugucuagauaL96 | 1465 |
| AD-67535.1 | A-135253.1 | csusuuugGfaGfGfCfagcuaggaaaL96 | 1466 |

TABLE 8-continued

PNPLA3 Modified Sequences

| | | | |
|---|---|---|---|
| AD-67530.1 | A-135243.1 | asasgacaAfuGfAfUfuuggguguuuaL96 | 1467 |
| AD-67542.1 | A-135267.1 | gsascaauGfaUfUfUfggguguuuagaL96 | 1468 |
| AD-67528.1 | A-135239.1 | csasaugaUfUfUfGfguguuuagaaaL96 | 1469 |
| AD-67527.1 | A-135237.1 | usgsccagAfuAfAfCfuuauuacuuuL96 | 1470 |
| AD-67544.1 | A-135271.1 | ascsaccuUfuGfGfCfucuuacuaauL96 | 1471 |
| AD-67532.1 | A-135247.1 | csusggcuCfcAfAfAfucuuuguauaL96 | 1472 |
| AD-67534.1 | A-135251.1 | usgsgcucCfaAfAfUfcuuuguauaaL96 | 1473 |
| AD-67538.1 | A-135259.1 | cscsaaauCfuUfUfGfuauagucauaL96 | 1474 |
| AD-67545.1 | A-135273.1 | asgsagacAfaAfGfUfgucuaggcuaL96 | 1475 |
| AD-67539.1 | A-135261.1 | asasguguCfuAfGfGfcuacacagaaL96 | 1476 |
| AD-67540.1 | A-135263.1 | asgsaaacUfuCfUfGfccuugcuuuaL96 | 1477 |
| AD-67531.1 | A-135245.1 | gsasaggaUfuGfAfAfuggauacacaL96 | 1478 |
| AD-67536.1 | A-135255.1 | gsgsauugAfaUfGfGfauacaccaaaL96 | 1479 |

| Duplex Name | Antisense Oligo Name | Antisense Sequence 5' to 3' | SEQ ID NO |
|---|---|---|---|
| AD-67524.1 | A-135232.1 | usUfsgguAfgAfAfgcccAfgGfaagccsgsc | 1480 |
| AD-67611.1 | A-135410.1 | usAfscucCfuGfGfccuuCfcGfcacaasgsa | 1481 |
| AD-67601.1 | A-135390.1 | asAfsuguUfcCfGfacucCfuGfgccuuscsc | 1482 |
| AD-67579.1 | A-135342.1 | usAfsaugUfuCfCfgacuCfcUfggccususc | 1483 |
| AD-67588.1 | A-135362.1 | asAfsaguCfaGfAfcaccAfgAfacguususu | 1484 |
| AD-67602.1 | A-135392.1 | usGfsucuUfuGfGfaccgAfaAfgucagsasc | 1485 |
| AD-67570.1 | A-135324.1 | asCfsgacUfuCfGfucuuUfuGfaccgasasa | 1486 |
| AD-67553.1 | A-135290.1 | usAfscgaCfuUfCfgucuUfuGfgaccgsasa | 1487 |
| AD-67612.1 | A-135412.1 | usAfsaggCfaUfCfcacgAfcUfucgucsusu | 1488 |
| AD-67525.1 | A-135234.1 | asUfsgaaGfcAfGfgaacAfuAfccaagsgsc | 1489 |
| AD-67526.1 | A-135236.1 | usAfsaggAfaGfGfagggAfuAfaggccsasc | 1490 |
| AD-67592.1 | A-135372.1 | usGfsuacGfuUfGfucacUfcAfcuccuscsc | 1491 |
| AD-67578.1 | A-135340.1 | usAfsaggGfuAfCfguugUfcAfcucacsusc | 1492 |
| AD-67555.1 | A-135294.1 | usUfsgauGfgUfUfguuuUfgGfcaucasasu | 1493 |
| AD-67577.1 | A-135338.1 | usUfsgacUfuUfAfgggcAfgAfugucgsusa | 1494 |
| AD-67594.1 | A-135376.1 | usUfsccaCfaUfGfaagaAfaGfuucgusgsg | 1495 |
| AD-67568.1 | A-135320.1 | usAfsaggUfaGfAfgguuCfcCfugugcsasg | 1496 |
| AD-67550.1 | A-135284.1 | usAfsaggCfaUfAfucucUfcCfcagcascsc | 1497 |
| AD-67586.1 | A-135358.1 | usUfscgaAfgGfCfauauCfuCfucccasgsc | 1498 |
| AD-67576.1 | A-135336.1 | usAfsuccUfcGfAfaggcAfuAfucucuscsc | 1499 |
| AD-67563.1 | A-135310.1 | usAfsaauAfuCfCfucgaAfgGfcauauscsu | 1500 |
| AD-67552.1 | A-135288.1 | asUfsccaAfaUfAfuccuCfgAfaggcasusa | 1501 |
| AD-67608.1 | A-135404.1 | usUfscucUfuCfCfaagaAfcCfugaausgsc | 1502 |
| AD-67593.1 | A-135374.1 | usAfsuccAfuCfCfcuucUfgAfggaugsasc | 1503 |

TABLE 8-continued

| PNPLA3 Modified Sequences | | | |
|---|---|---|---|
| AD-67609.1 | A-135406.1 | asUfsgcuCfuCfAfucccAfgGfgcaggsasu | 1504 |
| AD-67597.1 | A-135382.1 | usCfsucaUfgUfAfuccaCfcUfuugucsusu | 1505 |
| AD-67587.1 | A-135360.1 | usUfsugcUfcAfUfguauCfcAfccuuusgsu | 1506 |
| AD-67559.1 | A-135302.1 | asAfsaucUfuGfCfucauGfuAfuccacscsu | 1507 |
| AD-67561.1 | A-135306.1 | usAfsaauCfuUfGfcucaUfgUfauccascsc | 1508 |
| AD-67551.1 | A-135286.1 | usUfsgcaAfaUfCfuugcUfcAfuguauscsc | 1509 |
| AD-67591.1 | A-135370.1 | usAfsgcaAfgUfUfgcaaAfuCfuugcuscsa | 1510 |
| AD-67583.1 | A-135352.1 | usGfsuagCfaAfGfuugcAfaAfucuugscsu | 1511 |
| AD-67585.1 | A-135356.1 | usCfsuaaUfgGfGfuagcAfaGfuugcasasa | 1512 |
| AD-67589.1 | A-135364.1 | usAfsuccUfaAfUfgggUfAfgCfaaguusgsc | 1513 |
| AD-67595.1 | A-135378.1 | usCfsucuGfgAfCfaaucGfcAfauggcsasg | 1514 |
| AD-67580.1 | A-135344.1 | usUfscacCfaGfUfucuGfgAfcaaucsgsc | 1515 |
| AD-67573.1 | A-135330.1 | usAfsucuGfgAfAfgccaUfgUfcaccasgsu | 1516 |
| AD-67600.1 | A-135388.1 | usAfscauCfgUfCfgggcAfuAfucuggsasa | 1517 |
| AD-67603.1 | A-135394.1 | usAfsgguCfaCfCfcacuGfcAfaccacsasg | 1518 |
| AD-67598.1 | A-135384.1 | usCfsucaCfuGfGfcauuUfgGfgaccusgsg | 1519 |
| AD-67564.1 | A-135312.1 | usAfsgacUfcGfCfcuccUfcAfagugascsu | 1520 |
| AD-67574.1 | A-135332.1 | usCfsugaAfaGfAfaucuGfcUfagacuscsg | 1521 |
| AD-67590.1 | A-135366.1 | usUfsuuaGfcAfCfcucuGfaAfagaauscsu | 1522 |
| AD-67572.1 | A-135328.1 | asCfsuuuAfgCfAfccucUfgAfaagaasusc | 1523 |
| AD-67582.1 | A-135350.1 | asAfsagaUfgGfGfaaacUfuUfagcacscsu | 1524 |
| AD-67607.1 | A-135402.1 | usGfsuagCfuGfCfacaaAfgAfugggasasa | 1525 |
| AD-67571.1 | A-135326.1 | usAfsuccUfcCfAfcgucAfcAfggcagsgsg | 1526 |
| AD-67599.1 | A-135386.1 | usCfsuggGfaUfCfcuccAfcGfucacasgsg | 1527 |
| AD-67554.1 | A-135292.1 | asUfsaaaAfcCfAfacucAfgCfucagasgsg | 1528 |
| AD-67549.1 | A-135282.1 | usAfsgcuUfuUfCfauaaAfaCfcaacuscsa | 1529 |
| AD-67567.1 | A-135318.1 | usCfsuagCfuUfUfucauAfaAfaccaascsu | 1530 |
| AD-67558.1 | A-135300.1 | usUfsccuAfgCfUfuuucAfuAfaaaccsasa | 1531 |
| AD-67569.1 | A-135322.1 | usUfsuccUfaGfCfuuuuCfaUfaaaacscsa | 1532 |
| AD-67548.1 | A-135280.1 | usCfsuucCfuAfGfcuuuUfcAfuaaaascsc | 1533 |
| AD-67566.1 | A-135316.1 | usUfsugcUfuCfCfuagcUfuUfucauasasa | 1534 |
| AD-67613.1 | A-135414.1 | usCfsccaAfcCfAfgcugAfaUfuaacgscsa | 1535 |
| AD-67610.1 | A-135408.1 | usUfscccAfaCfCfagcuGfaAfuuaacsgsc | 1536 |
| AD-67556.1 | A-135296.1 | usGfsuguCfaUfUfucccAfaCfcagcusgsa | 1537 |
| AD-67581.1 | A-135346.1 | asAfscagUfcUfGfaccaUfuAfauaggsgsc | 1538 |
| AD-67560.1 | A-135304.1 | usAfsacaGfuCfUfgaccAfuUfaauagsgsg | 1539 |
| AD-67596.1 | A-135380.1 | usAfsagaUfcAfCfacauGfgGfccagcscsu | 1540 |
| AD-67557.1 | A-135298.1 | usAfscaaGfaUfCfacacAfuGfggccasgsc | 1541 |
| AD-67584.1 | A-135354.1 | usUfsaaaCfaUfUfauuuUfaGfuuaggsusg | 1542 |

TABLE 8-continued

PNPLA3 Modified Sequences

| | | | |
|---|---|---|---|
| AD-67575.1 | A-135334.1 | asAfsuacAfaAfAfuucaAfcAfgguaascsa | 1543 |
| AD-67605.1 | A-135398.1 | asUfsaauAfcAfAfaauuCfaAfcaggusasa | 1544 |
| AD-67562.1 | A-135308.1 | usUfscacUfgAfUfucacAfuAfauacasasa | 1545 |
| AD-67606.1 | A-135400.1 | asAfscauCfuCfAfcugaUfuCfacauasasu | 1546 |
| AD-67604.1 | A-135396.1 | asAfsggcUfuAfUfucuaCfuAfacaucsusc | 1547 |
| AD-67565.1 | A-135314.1 | usAfsaggCfuUfAfuucuAfcUfaacauscsu | 1548 |
| AD-67529.1 | A-135242.1 | usCfscauGfaGfGfaucuCfcAfuuauascsg | 1549 |
| AD-67533.1 | A-135250.1 | usUfsuggAfaUfGfgaacUfcAfgacacscsa | 1550 |
| AD-67537.1 | A-135258.1 | usAfscacCfaGfGfgcauCfcAfcgacususc | 1551 |
| AD-67546.1 | A-135276.1 | usUfsccaGfgUfAfcccuUfgAfuagcascsa | 1552 |
| AD-67547.1 | A-135278.1 | usAfsuucGfgGfCfacaaAfcCfugggasusg | 1553 |
| AD-67543.1 | A-135270.1 | usUfscauUfcGfGfgcacAfaAfccuggsgsa | 1554 |
| AD-67541.1 | A-135266.1 | usAfsucuAfgAfCfacugUfuGfcuccasgsa | 1555 |
| AD-67535.1 | A-135254.1 | usUfsuccUfaGfCfugccUfcCfaaaagsusa | 1556 |
| AD-67530.1 | A-135244.1 | usAfsaacAfcCfAfaaucAfuUfgucuusug | 1557 |
| AD-67542.1 | A-135268.1 | usCfsuaaAfcAfCfcaaaUfcAfuugucsusu | 1558 |
| AD-67528.1 | A-135240.1 | usUfsucuAfaAfCfaccaAfaUfcauugsusc | 1559 |
| AD-67527.1 | A-135238.1 | asAfsaguAfaUfAfaguuAfuCfuggcasgsg | 1560 |
| AD-67544.1 | A-135272.1 | asUfsuagUfaAfGfagccAfaAfggugucscsc | 1561 |
| AD-67532.1 | A-135248.1 | usAfsuacAfaAfGfauuuGfaAfgccagsusg | 1562 |
| AD-67534.1 | A-135252.1 | usUfsauaCfaAfAfgauuUfgGfagccasgsu | 1563 |
| AD-67538.1 | A-135260.1 | usAfsugaCfuAfUfacaaAfgAfuuuggsasg | 1564 |
| AD-67545.1 | A-135274.1 | usAfsgccUfaGfAfcacuUfuGfucucusasg | 1565 |
| AD-67539.1 | A-135262.1 | usUfscugUfgUfAfgccuAfgAfcacuusug | 1566 |
| AD-67540.1 | A-135264.1 | usAfsaagCfaAfGfgcagAfaGfuuucusasc | 1567 |
| AD-67531.1 | A-135246.1 | usGfsuguAfuCfCfauucAfaAfUfccuucsusg | 1568 |
| AD-67536.1 | A-135256.1 | usUfsuggUfgUfAfuccaUfuCfaauccsusu | 1569 |

TABLE 9

PNPLA3 mRNA Target Sequences of Modifed PNPLA3 Agents in

TABLE 9-continued

PNPLA3 mRNA Target Sequences of Modifed PNPLA3 Agents in Table 8

| Duplex Name | Sense Oligo Name | Antissense Oligo Name | mRNA target sequence | SEQ ID NO |
|---|---|---|---|---|
| AD-67553.1 | A-135289.1 | A-135290.1 | UUCGGUCCAAAGACGAAGUCGUG | 1577 |
| AD-67612.1 | A-135411.1 | A-135412.1 | AAGACGAAGUCGUGGAUGCCUUG | 1578 |
| AD-67525.1 | A-135233.1 | A-135234.1 | GCCUUGGUAUGUUCCUGCUUCAU | 1579 |
| AD-67526.1 | A-135235.1 | A-135236.1 | GUGGCCUUAUCCCUCCUUCCUUC | 1580 |
| AD-67592.1 | A-135371.1 | A-135372.1 | GGAGGAGUGAGUGACAACGUACC | 1581 |
| AD-67578.1 | A-135339.1 | A-135340.1 | GAGUGAGUGACAACGUACCCUUC | 1582 |
| AD-67555.1 | A-135293.1 | A-135294.1 | AUUGAUGCCAAAACAACCAUCAC | 1583 |
| AD-67577.1 | A-135337.1 | A-135338.1 | UACGACAUCUGCCCUAAAGUCAA | 1584 |
| AD-67594.1 | A-135375.1 | A-135376.1 | CCACGAACUUUCUUCAUGUGGAC | 1585 |
| AD-67568.1 | A-135319.1 | A-135320.1 | CUGCACAGGGAACCUCUACCUUC | 1586 |
| AD-67550.1 | A-135283.1 | A-135284.1 | GGUGCUGGGAGAGAUAUGCCUUC | 1587 |
| AD-67586.1 | A-135357.1 | A-135358.1 | GCUGGGAGAGAUAUGCCUUCGAG | 1588 |
| AD-67576.1 | A-135335.1 | A-135336.1 | GGAGAGAUAUGCCUUCGAGGAUA | 1589 |
| AD-67563.1 | A-135309.1 | A-135310.1 | AGAUAUGCCUUCGAGGAUAUUUG | 1590 |
| AD-67552.1 | A-135287.1 | A-135288.1 | UAUGCCUUCGAGGAUAUUUGGAU | 1591 |
| AD-67608.1 | A-135403.1 | A-135404.1 | GCAUUCAGGUUCUUGGAAGAGAA | 1592 |
| AD-67593.1 | A-135373.1 | A-135374.1 | GUCAUCCUCAGAAGGGAUGGAUC | 1593 |
| AD-67609.1 | A-135405.1 | A-135406.1 | AUCCUGCCCUGGGAUGAGAGCAU | 1594 |
| AD-67597.1 | A-135381.1 | A-135382.1 | AAGACAAAGGUGGAUACAUGAGC | 1595 |
| AD-67587.1 | A-135359.1 | A-135360.1 | ACAAAGGUGGAUACAUGAGCAAG | 1596 |
| AD-67559.1 | A-135301.1 | A-135302.1 | AGGUGGAUACAUGAGCAAGAUUU | 1597 |
| AD-67561.1 | A-135305.1 | A-135306.1 | GGUGGAUACAUGAGCAAGAUUUG | 1598 |
| AD-67551.1 | A-135285.1 | A-135286.1 | GGAUACAUGAGCAAGAUUUGCAA | 1599 |
| AD-67591.1 | A-135369.1 | A-135370.1 | UGAGCAAGAUUUGCAACUUGCUA | 1600 |
| AD-67583.1 | A-135351.1 | A-135352.1 | AGCAAGAUUUGCAACUUGCUACC | 1601 |
| AD-67585.1 | A-135355.1 | A-135356.1 | UUUGCAACUUGCUACCAUUAGG | 1602 |
| AD-67589.1 | A-135363.1 | A-135364.1 | GCAACUUGCUACCCAUUAGGAUA | 1603 |
| AD-67595.1 | A-135377.1 | A-135378.1 | CUGCCAUUGCGAUUGUCCAGAGA | 1604 |
| AD-67580.1 | A-135343.1 | A-135344.1 | GCGAUUGUCCAGAGACUGGUGAC | 1605 |
| AD-67573.1 | A-135329.1 | A-135330.1 | ACUGGUGACAUGGCUUCCAGAUA | 1606 |
| AD-67600.1 | A-135387.1 | A-135388.1 | UUCCAGAUAUGCCCGACGAUGUC | 1607 |
| AD-67603.1 | A-135393.1 | A-135394.1 | CUGUGGUUGCAGUGGGUGACCUC | 1608 |
| AD-67598.1 | A-135383.1 | A-135384.1 | CCAGGUCCCAAAUGCCAGUGAGC | 1609 |
| AD-67564.1 | A-135311.1 | A-135312.1 | AGUCACUUGAGGAGGCGAGUCUA | 1610 |
| AD-67574.1 | A-135331.1 | A-135332.1 | CGAGUCUAGCAGAUUCUUUCAGA | 1611 |
| AD-67590.1 | A-135365.1 | A-135366.1 | AGAUUCUUUCAGAGGUGCUAAAG | 1612 |
| AD-67572.1 | A-135327.1 | A-135328.1 | GAUUCUUUCAGAGGUGCUAAAGU | 1613 |

TABLE 9-continued

PNPLA3 mRNA Target Sequences of Modifed PNPLA3 Agents in Table 8

| Duplex Name | Sense Oligo Name | Antissense Oligo Name | mRNA target sequence | SEQ ID NO |
|---|---|---|---|---|
| AD-67582.1 | A-135349.1 | A-135350.1 | AGGUGCUAAAGUUUCCCAUCUUU | 1614 |
| AD-67607.1 | A-135401.1 | A-135402.1 | UUUCCCAUCUUUGUGCAGCUACC | 1615 |
| AD-67571.1 | A-135325.1 | A-135326.1 | CCCUGCCUGUGACGUGGAGGAUC | 1616 |
| AD-67599.1 | A-135385.1 | A-135386.1 | CCUGUGACGUGGAGGAUCCCAGC | 1617 |
| AD-67554.1 | A-135291.1 | A-135292.1 | CCUCUGAGCUGAGUUGGUUUUAU | 1618 |
| AD-67549.1 | A-135281.1 | A-135282.1 | UGAGUUGGUUUUAUGAAAAGCUA | 1619 |
| AD-67567.1 | A-135317.1 | A-135318.1 | AGUUGGUUUUAUGAAAAGCUAGG | 1620 |
| AD-67558.1 | A-135299.1 | A-135300.1 | UUGGUUUUAUGAAAAGCUAGGAA | 1621 |
| AD-67569.1 | A-135321.1 | A-135322.1 | UGGUUUUAUGAAAAGCUAGGAAG | 1622 |
| AD-67548.1 | A-135279.1 | A-135280.1 | GGUUUUAUGAAAAGCUAGGAAGC | 1623 |
| AD-67566.1 | A-135315.1 | A-135316.1 | UUUAUGAAAAGCUAGGAAGCAAC | 1624 |
| AD-67613.1 | A-135413.1 | A-135414.1 | UGCGUUAAUUCAGCUGGUUGGGA | 1625 |
| AD-67610.1 | A-135407.1 | A-135408.1 | GCGUUAAUUCAGCUGGUUGGGAA | 1626 |
| AD-67556.1 | A-135295.1 | A-135296.1 | UCAGCUGGUUGGGAAAUGACACC | 1627 |
| AD-67581.1 | A-135345.1 | A-135346.1 | GCCCUAUUAAUGGUCAGACUGUU | 1628 |
| AD-67560.1 | A-135303.1 | A-135304.1 | CCCUAUUAAUGGUCAGACUGUUC | 1629 |
| AD-67596.1 | A-135379.1 | A-135380.1 | AGGCUGGCCCAUGUGUGAUCUUG | 1630 |
| AD-67557.1 | A-135297.1 | A-135298.1 | GCUGGCCCAUGUGUGAUCUUGUG | 1631 |
| AD-67584.1 | A-135353.1 | A-135354.1 | CACCUAACUAAAAUAAUGUUUAA | 1632 |
| AD-67575.1 | A-135333.1 | A-135334.1 | UGUUACCUGUUGAAUUUUGUAUU | 1633 |
| AD-67605.1 | A-135397.1 | A-135398.1 | UUACCUGUUGAAUUUUGUAUUAU | 1634 |
| AD-67562.1 | A-135307.1 | A-135308.1 | UUUGUAUUAUGUGAAUCAGUGAG | 1635 |
| AD-67606.1 | A-135399.1 | A-135400.1 | AUUAUGUGAAUCAGUGAGAUGUU | 1636 |
| AD-67604.1 | A-135395.1 | A-135396.1 | GAGAUGUUAGUAGAAUAAGCCUU | 1637 |
| AD-67565.1 | A-135313.1 | A-135314.1 | AGAUGUUAGUAGAAUAAGCCUUA | 1638 |
| AD-67529.1 | A-135241.1 | A-135242.1 | CGUAUAAUGGAGAUCCUCAUGGA | 1639 |
| AD-67533.1 | A-135249.1 | A-135250.1 | UGGUGUCUGAGUUCCAUUCCAAA | 1640 |
| AD-67537.1 | A-135257.1 | A-135258.1 | GAAGUCGUGGAUGCCCUGGUGUG | 1641 |
| AD-67546.1 | A-135275.1 | A-135276.1 | UGUGCUAUCAAGGGUACCUGGAC | 1642 |
| AD-67547.1 | A-135277.1 | A-135278.1 | CAUCCCAGGUUUGUGCCCGAAUG | 1643 |
| AD-67543.1 | A-135269.1 | A-135270.1 | UCCCAGGUUUGUGCCCGAAUGAC | 1644 |
| AD-67541.1 | A-135265.1 | A-135266.1 | UCUGGAGCAACAGUGUCUAGAUG | 1645 |
| AD-67535.1 | A-135253.1 | A-135254.1 | UACUUUUGGAGGCAGCUAGGAAG | 1646 |
| AD-67530.1 | A-135243.1 | A-135244.1 | CAAAGACAAUGAUUUGGUGUUUA | 1647 |
| AD-67542.1 | A-135267.1 | A-135268.1 | AAGACAAUGAUUUGGUGUUUAGA | 1648 |
| AD-67528.1 | A-135239.1 | A-135240.1 | GACAAUGAUUUGGUGUUUAGAAA | 1649 |
| AD-67527.1 | A-135237.1 | A-135238.1 | CCUGCCAGAUAACUUAUUACUUU | 1650 |
| AD-67544.1 | A-135271.1 | A-135272.1 | GGACACCUUUGGCUCUUACUAAU | 1651 |

TABLE 9-continued

PNPLA3 mRNA Target Sequences of Modifed PNPLA3 Agents in Table 8

| Duplex Name | Sense Oligo Name | Antissense Oligo Name | mRNA target sequence | SEQ ID NO |
|---|---|---|---|---|
| AD-67532.1 | A-135247.1 | A-135248.1 | CACUGGCUCCAAAUCUUUGUAUA | 1652 |
| AD-67534.1 | A-135251.1 | A-135252.1 | ACUGGCUCCAAAUCUUUGUAUAG | 1653 |
| AD-67538.1 | A-135259.1 | A-135260.1 | CUCCAAAUCUUUGUAUAGUCAUC | 1654 |
| AD-67545.1 | A-135273.1 | A-135274.1 | CUAGAGACAAAGUGUCUAGGCUA | 1655 |
| AD-67539.1 | A-135261.1 | A-135262.1 | CAAAGUGUCUAGGCUACACAGAA | 1656 |
| AD-67540.1 | A-135263.1 | A-135264.1 | GUAGAAACUUCUGCCUUGCUUUG | 1657 |
| AD-67531.1 | A-135245.1 | A-135246.1 | CAGAAGGAUUGAAUGGAUACACC | 1658 |
| AD-67536.1 | A-135255.1 | A-135256.1 | AAGGAUUGAAUGGAUACACCAAA | 1659 |

TABLE 10

Hep3B PNPLA3 endogenous in vitro 10 nM and 0.1 nM single dose screen

| Duplex Name | 10 nM_AVG | 10 10nM_STDEV | 0.1 nM_AVG | 0.1 nM_STDEV |
|---|---|---|---|---|
| AD-67524.1 | 85.34 | 6.47 | 90.33 | 14.17 |
| AD-67611.1 | 111.68 | 23.20 | 95.28 | 9.27 |
| AD-67601.1 | 86.74 | 11.59 | 86.84 | 15.67 |
| AD-67579.1 | 89.60 | 12.00 | 58.82 | 15.51 |
| AD-67588.1 | 57.73 | 16.50 | 64.15 | 8.44 |
| AD-67602.1 | 66.35 | 12.49 | 86.76 | 8.21 |
| AD-67570.1 | 72.72 | 8.21 | 85.53 | 5.27 |
| AD-67553.1 | 67.90 | 6.88 | 84.25 | 11.40 |
| AD-67612.1 | 62.03 | 12.34 | 51.52 | 5.24 |
| AD-67525.1 | 42.50 | 9.07 | 65.77 | 14.98 |
| AD-67526.1 | 45.14 | 9.69 | 58.35 | 4.26 |
| AD-67592.1 | 55.32 | 9.06 | 58.01 | 6.50 |
| AD-67578.1 | 51.16 | 8.74 | 53.17 | 15.71 |
| AD-67555.1 | 92.88 | 23.69 | 66.11 | 10.08 |
| AD-67577.1 | 53.93 | 9.32 | 55.41 | 5.82 |
| AD-67594.1 | 79.39 | 12.41 | 78.57 | 7.33 |
| AD-67568.1 | 43.12 | 7.69 | 65.24 | 11.56 |
| AD-67550.1 | 62.65 | 16.23 | 87.64 | 22.99 |
| AD-67586.1 | 57.51 | 11.23 | 66.30 | 21.67 |
| AD-67576.1 | 62.33 | 9.41 | 66.43 | 17.91 |
| AD-67563.1 | 56.23 | 17.97 | 69.60 | 6.43 |
| AD-67552.1 | 55.69 | 5.10 | 103.09 | 5.25 |
| AD-67608.1 | 51.30 | 15.89 | 53.54 | 16.44 |
| AD-67593.1 | 52.04 | 9.82 | 69.34 | 7.89 |
| AD-67609.1 | 90.41 | 32.12 | 73.63 | 16.54 |
| AD-67597.1 | 78.98 | 19.93 | 90.94 | 16.10 |
| AD-67587.1 | 81.37 | 16.51 | 70.07 | 28.64 |
| AD-67559.1 | 71.11 | 9.40 | 96.14 | 12.25 |
| AD-67561.1 | 50.85 | 14.84 | 56.18 | 15.19 |
| AD-67551.1 | 37.30 | 6.63 | 53.00 | 4.52 |
| AD-67591.1 | 70.98 | 19.00 | 93.65 | 11.21 |
| AD-67583.1 | 65.57 | 7.72 | 80.60 | 14.05 |
| AD-67585.1 | 53.90 | 14.18 | 52.77 | 10.67 |
| AD-67589.1 | 43.29 | 5.45 | 54.29 | 4.43 |
| AD-67595.1 | 83.09 | 44.03 | 88.45 | 13.90 |
| AD-67580.1 | 88.42 | 14.74 | 74.18 | 8.01 |
| AD-67573.1 | 60.57 | 4.91 | 71.22 | 17.26 |
| AD-67600.1 | 70.88 | 0.97 | 65.57 | 10.49 |
| AD-67603.1 | 100.97 | 25.43 | 86.68 | 16.12 |
| AD-67598.1 | 55.25 | 6.91 | 79.47 | 10.06 |
| AD-67564.1 | 65.67 | 14.01 | 60.23 | 4.86 |
| AD-67574.1 | 63.24 | 16.91 | 68.91 | 19.35 |
| AD-67590.1 | 70.11 | 7.76 | 68.94 | 18.75 |
| AD-67572.1 | 86.54 | 6.37 | 95.11 | 36.91 |
| AD-67582.1 | 57.31 | 14.76 | 52.76 | 8.24 |
| AD-67607.1 | 59.03 | 14.94 | 59.28 | 10.58 |
| AD-67571.1 | 99.63 | 15.80 | 89.53 | 6.64 |
| AD-67599.1 | 94.78 | 19.21 | 87.91 | 7.53 |
| AD-67554.1 | 36.53 | 8.09 | 56.06 | 5.32 |
| AD-67549.1 | 56.20 | 20.65 | 56.90 | 10.27 |
| AD-67567.1 | 57.81 | 4.61 | 67.97 | 17.13 |
| AD-67558.1 | 57.17 | 10.26 | 60.10 | 11.12 |
| AD-67569.1 | 66.43 | 25.81 | 58.49 | 14.52 |
| AD-67548.1 | 52.14 | 8.72 | 75.41 | 15.44 |
| AD-67566.1 | 54.88 | 11.91 | 51.93 | 11.84 |
| AD-67613.1 | 83.78 | 26.96 | 79.37 | 8.59 |
| AD-67610.1 | 78.50 | 18.94 | 80.88 | 11.97 |
| AD-67556.1 | 87.08 | 5.39 | 87.94 | 8.28 |
| AD-67581.1 | 52.21 | 11.55 | 84.89 | 7.12 |
| AD-67560.1 | 51.65 | 4.09 | 67.85 | 6.59 |
| AD-67596.1 | 82.71 | 20.80 | 76.57 | 11.58 |
| AD-67557.1 | 56.15 | 8.28 | 90.70 | 5.11 |
| AD-67584.1 | 42.16 | 6.42 | 38.63 | 13.85 |
| AD-67575.1 | 42.62 | 11.19 | 54.35 | 9.20 |
| AD-67605.1 | 43.75 | 11.62 | 59.95 | 7.68 |
| AD-67562.1 | 73.26 | 11.12 | 72.58 | 11.11 |
| AD-67606.1 | 86.42 | 38.80 | 75.45 | 12.67 |
| AD-67604.1 | 64.47 | 6.80 | 72.33 | 10.76 |
| AD-67565.1 | 49.43 | 3.37 | 54.34 | 12.25 |
| AD-67529.1 | 96.11 | 23.73 | 104.54 | 5.56 |
| AD-67533.1 | 91.29 | 27.25 | 102.72 | 10.83 |
| AD-67537.1 | 96.12 | 30.20 | 90.92 | 17.55 |
| AD-67546.1 | 117.18 | 35.85 | 90.75 | 10.80 |
| AD-67547.1 | 109.66 | 23.27 | 110.07 | 17.90 |
| AD-67543.1 | 106.67 | 27.98 | 103.10 | 22.41 |
| AD-67541.1 | 112.89 | 34.51 | 105.50 | 18.29 |
| AD-67535.1 | 95.95 | 17.30 | 111.96 | 8.37 |
| AD-67530.1 | 86.64 | 13.15 | 89.64 | 10.56 |
| AD-67542.1 | 108.30 | 12.22 | 111.03 | 18.93 |
| AD-67528.1 | 86.06 | 15.40 | 100.52 | 11.52 |
| AD-67527.1 | 94.22 | 9.43 | 103.95 | 8.31 |
| AD-67544.1 | 95.63 | 16.01 | 94.25 | 5.66 |
| AD-67532.1 | 96.24 | 10.13 | 114.20 | 14.38 |
| AD-67534.1 | 104.27 | 20.55 | 101.24 | 14.18 |
| AD-67538.1 | 108.29 | 29.79 | 99.37 | 10.01 |
| AD-67545.1 | 110.68 | 11.06 | 143.56 | 45.88 |
| AD-67539.1 | 106.92 | 43.45 | 107.56 | 15.77 |
| AD-67540.1 | 104.01 | 18.83 | 105.58 | 12.67 |
| AD-67531.1 | 117.06 | 37.65 | 102.32 | 27.15 |
| AD-67536.1 | 104.51 | 7.42 | 110.11 | 14.23 |

TABLE 11

Cynomolgus monkey PNPLA3 endogenous in vitro
10 nM and 0.1 nM single dose screen

| Duplex Name | 10 nM_AVG | 10 nM_STDEV | 0.1 nM_AVG | 0.1 nM_STDEV |
|---|---|---|---|---|
| AD-67524.1 | 64.22 | 12.50 | 98.57 | 57.56 |
| AD-67611.1 | 201.95 | 55.02 | 147.71 | 34.65 |
| AD-67601.1 | 106.76 | 23.66 | 104.01 | 20.80 |
| AD-67579.1 | 69.15 | 24.02 | 39.69 | 7.49 |
| AD-67588.1 | 34.18 | 13.04 | 58.34 | 19.48 |
| AD-67602.1 | 64.07 | 21.95 | 114.16 | 40.22 |
| AD-67570.1 | 45.66 | 21.83 | 92.73 | 22.46 |
| AD-67553.1 | 61.54 | 20.51 | 78.87 | 33.03 |
| AD-67612.1 | 49.05 | 10.63 | 68.98 | 21.48 |
| AD-67525.1 | 58.61 | 6.56 | 83.50 | 29.86 |
| AD-67526.1 | 48.75 | 19.00 | 81.70 | 44.79 |
| AD-67592.1 | 54.34 | 23.45 | 107.45 | 52.70 |
| AD-67578.1 | 54.22 | 18.19 | 62.05 | 18.44 |
| AD-67555.1 | 83.45 | 13.63 | 96.21 | 32.86 |
| AD-67577.1 | 41.40 | 13.97 | 50.80 | 20.40 |
| AD-67594.1 | 71.17 | 26.23 | 90.30 | 12.23 |
| AD-67568.1 | 28.74 | 8.05 | 56.57 | 12.90 |
| AD-67550.1 | 67.27 | 14.09 | 102.11 | 22.04 |
| AD-67586.1 | 44.83 | 10.13 | 52.06 | 1.96 |
| AD-67576.1 | 61.04 | 36.58 | 78.16 | 7.18 |
| AD-67563.1 | 85.83 | 27.55 | 88.34 | 7.26 |
| AD-67552.1 | 70.65 | 36.42 | 112.67 | 14.77 |
| AD-67608.1 | 65.16 | 37.26 | 90.87 | 21.05 |
| AD-67593.1 | 72.95 | 19.92 | 108.58 | 27.09 |
| AD-67609.1 | 83.80 | 52.06 | 113.25 | 23.43 |
| AD-67597.1 | 57.86 | 7.16 | 101.52 | 29.68 |
| AD-67587.1 | 71.36 | 33.38 | 83.46 | 28.71 |
| AD-67559.1 | 38.13 | 5.57 | 85.54 | 20.52 |
| AD-67561.1 | 49.61 | 17.03 | 75.51 | 35.59 |
| AD-67551.1 | 24.74 | 13.01 | 57.84 | 19.55 |
| AD-67591.1 | 65.58 | 11.64 | 70.61 | 18.06 |
| AD-67583.1 | 35.16 | 12.01 | 56.71 | 13.29 |
| AD-67585.1 | 51.64 | 38.68 | 91.09 | 23.58 |
| AD-67589.1 | 30.43 | 8.50 | 55.59 | 15.49 |
| AD-67595.1 | 64.53 | 12.69 | 108.07 | 61.59 |
| AD-67580.1 | 52.22 | 14.63 | 59.80 | 19.21 |
| AD-67573.1 | 47.55 | 19.02 | 69.12 | 8.02 |
| AD-67600.1 | 55.58 | 11.69 | 92.41 | 26.52 |
| AD-67603.1 | 119.04 | 50.54 | 152.95 | 37.00 |
| AD-67598.1 | 51.72 | 17.51 | 84.34 | 25.38 |
| AD-67564.1 | 58.62 | 27.17 | 77.33 | 37.58 |
| AD-67574.1 | 33.51 | 14.78 | 45.90 | 17.45 |
| AD-67590.1 | 40.45 | 9.84 | 56.63 | 12.25 |
| AD-67572.1 | 47.06 | 14.49 | 77.89 | 27.67 |
| AD-67582.1 | 27.10 | 5.89 | 49.41 | 18.11 |
| AD-67607.1 | 43.61 | 8.27 | 72.35 | 13.09 |
| AD-67571.1 | 109.27 | 56.41 | 69.47 | 23.50 |
| AD-67599.1 | 83.03 | 58.74 | 83.94 | 15.01 |
| AD-67554.1 | 19.86 | 10.03 | 85.24 | 13.88 |
| AD-67549.1 | 38.63 | 14.53 | 94.17 | 23.93 |
| AD-67567.1 | 31.60 | 11.57 | 71.66 | 11.57 |
| AD-67558.1 | 39.31 | 19.51 | 67.91 | 23.15 |
| AD-67569.1 | 35.42 | 13.52 | 37.45 | 9.62 |
| AD-67548.1 | 84.14 | 21.27 | 83.38 | 26.65 |
| AD-67566.1 | 26.85 | 5.90 | 47.24 | 9.79 |
| AD-67613.1 | 90.32 | 43.98 | 110.21 | 22.37 |
| AD-67610.1 | 76.90 | 29.15 | 116.95 | 25.59 |
| AD-67556.1 | 99.65 | 38.94 | 78.32 | 27.42 |
| AD-67581.1 | 31.34 | 9.79 | 69.04 | 11.53 |
| AD-67560.1 | 25.86 | 10.00 | 49.96 | 14.82 |
| AD-67596.1 | 70.39 | 22.12 | 83.45 | 32.21 |
| AD-67557.1 | 30.36 | 3.67 | 77.23 | 33.61 |
| AD-67584.1 | 30.34 | 10.44 | 35.30 | 9.75 |
| AD-67575.1 | 29.04 | 9.17 | 48.86 | 8.65 |
| AD-67605.1 | 62.92 | 35.30 | 97.67 | 46.22 |
| AD-67562.1 | 149.14 | 76.05 | 137.22 | 31.54 |
| AD-67606.1 | 53.08 | 12.65 | 76.76 | 17.13 |
| AD-67604.1 | 45.22 | 6.49 | 90.48 | 27.49 |
| AD-67565.1 | 58.35 | 24.21 | 60.94 | 28.29 |
| AD-67529.1 | 158.59 | 45.47 | 150.25 | 53.50 |
| AD-67533.1 | 142.31 | 43.60 | 146.81 | 39.93 |
| AD-67537.1 | 141.43 | 43.53 | 173.26 | 50.75 |
| AD-67546.1 | 176.38 | 88.77 | 147.25 | 35.28 |
| AD-67547.1 | 160.76 | 104.70 | 125.22 | 35.52 |
| AD-67543.1 | 117.94 | 26.94 | 178.90 | 44.99 |
| AD-67541.1 | 171.26 | 52.40 | 148.66 | 41.86 |
| AD-67535.1 | 117.80 | 12.65 | 154.87 | 34.75 |
| AD-67530.1 | 130.28 | 46.60 | 124.85 | 37.32 |
| AD-67542.1 | 130.98 | 44.83 | 158.70 | 46.06 |
| AD-67528.1 | 131.06 | 56.44 | 149.25 | 40.56 |
| AD-67527.1 | 128.94 | 29.24 | 154.29 | 24.13 |
| AD-67544.1 | 122.80 | 57.17 | 155.85 | 21.25 |
| AD-67532.1 | 73.68 | 20.38 | 130.31 | 58.83 |
| AD-67534.1 | 173.61 | 86.25 | 174.54 | 61.47 |
| AD-67538.1 | 153.55 | 53.00 | 170.55 | 45.06 |
| AD-67545.1 | 139.49 | 20.95 | 128.18 | 37.75 |
| AD-67539.1 | 258.50 | 123.06 | 144.40 | 39.80 |
| AD-67540.1 | 139.83 | 54.43 | 134.33 | 34.88 |
| AD-67531.1 | 131.80 | 41.72 | 155.34 | 63.49 |
| AD-67536.1 | 143.28 | 42.58 | 150.88 | 41.76 |

TABLE 12

Cynomolgus monkey PNPLA3
endogenous in vitro dose response screen

| Duplex Name | IC$_{50}$ (nM) |
|---|---|
| AD-67525.1 | 0.003 |
| AD-67526.1 | 0.005 |
| AD-67551.1 | 0.298 |
| AD-67554.1 | 0.003 |
| AD-67560.1 | 0.034 |
| AD-67568.1 | 0.049 |
| AD-67575.1 | 0.317 |
| AD-67577.1 | 0.001 |
| AD-67578.1 | 0.001 |
| AD-67581.1 | 0.081 |
| AD-67582.1 | 0.058 |
| AD-67584.1 | 0.001 |
| AD-67585.1 | 0.038 |
| AD-67592.1 | 0.216 |
| AD-67605.1 | 0.123 |
| AD-67612.1 | 1.381 |

TABLE 13

Mouse PNPLA3 endogenous in vitro
10 nM and 0.1 nM single dose screen

| Duplex Name | 10 nM_AVG | 10 nM_STDEV | 0.1 nM_AVG | 0.1 nM_STDEV |
|---|---|---|---|---|
| AD-67524.1 | 59.20 | 19.07 | 172.14 | 102.64 |
| AD-67611.1 | 101.53 | 39.04 | 166.84 | 16.96 |
| AD-67601.1 | 106.69 | 30.70 | 133.40 | 10.57 |
| AD-67579.1 | 93.33 | 23.59 | 111.59 | 17.65 |
| AD-67588.1 | 87.03 | 12.30 | 114.60 | 9.93 |
| AD-67602.1 | 99.22 | 9.70 | 127.47 | 8.95 |
| AD-67570.1 | 19.23 | 14.62 | 74.87 | 29.73 |
| AD-67553.1 | 15.43 | 7.94 | 60.49 | 46.00 |
| AD-67612.1 | 28.43 | 11.87 | 91.40 | 64.47 |
| AD-67525.1 | 39.75 | 26.63 | 140.88 | 39.79 |
| AD-67526.1 | 16.16 | 5.74 | 97.66 | 43.58 |
| AD-67592.1 | 25.04 | 16.02 | 117.35 | 19.59 |
| AD-67578.1 | 27.07 | 18.71 | 138.94 | 57.91 |
| AD-67555.1 | 43.71 | 36.83 | 148.89 | 53.90 |
| AD-67577.1 | 35.95 | 24.04 | 106.43 | 62.19 |
| AD-67594.1 | 118.99 | 24.43 | 118.98 | 22.56 |
| AD-67568.1 | 22.01 | 15.09 | 104.04 | 28.73 |
| AD-67550.1 | 128.32 | 33.32 | 153.22 | 21.77 |
| AD-67586.1 | 74.59 | 3.44 | 106.75 | 20.87 |
| AD-67576.1 | 79.48 | 5.82 | 129.09 | 31.89 |

TABLE 13-continued

Mouse PNPLA3 endogenous in vitro 10 nM and 0.1 nM single dose screen

| Duplex Name | 10 nM_AVG | 10 nM_STDEV | 0.1 nM_AVG | 0.1 nM_STDEV |
|---|---|---|---|---|
| AD-67563.1 | 141.90 | 59.30 | 132.24 | 34.38 |
| AD-67552.1 | 143.18 | 49.65 | 124.20 | 18.26 |
| AD-67608.1 | 154.76 | 66.58 | 190.93 | 42.10 |
| AD-67593.1 | 112.21 | 46.12 | 116.10 | 14.11 |
| AD-67609.1 | 164.89 | 46.54 | 171.23 | 27.85 |
| AD-67597.1 | 145.67 | 37.55 | 143.83 | 34.86 |
| AD-67587.1 | 102.09 | 20.42 | 106.63 | 18.56 |
| AD-67559.1 | 126.57 | 13.72 | 137.00 | 24.64 |
| AD-67561.1 | 121.82 | 26.66 | 151.62 | 35.30 |
| AD-67551.1 | 152.46 | 60.75 | 133.95 | 21.61 |
| AD-67591.1 | 166.93 | 65.07 | 145.36 | 28.46 |
| AD-67583.1 | 127.60 | 32.09 | 142.44 | 42.81 |
| AD-67585.1 | 99.84 | 23.69 | 148.35 | 48.23 |
| AD-67589.1 | 106.32 | 18.73 | 156.26 | 53.14 |
| AD-67595.1 | 105.40 | 18.78 | 123.24 | 28.02 |
| AD-67580.1 | 105.49 | 27.33 | 127.82 | 10.97 |
| AD-67573.1 | 17.45 | 7.76 | 126.15 | 41.24 |
| AD-67600.1 | 86.36 | 21.17 | 126.08 | 20.47 |
| AD-67603.1 | 104.95 | 35.50 | 142.30 | 15.52 |
| AD-67598.1 | 95.85 | 23.74 | 172.20 | 35.33 |
| AD-67564.1 | 109.00 | 17.65 | 121.28 | 23.44 |
| AD-67574.1 | 86.31 | 11.33 | 131.22 | 27.38 |
| AD-67590.1 | 136.21 | 58.52 | 123.09 | 14.38 |
| AD-67572.1 | 139.23 | 24.55 | 115.97 | 17.05 |
| AD-67582.1 | 126.01 | 33.04 | 165.25 | 40.55 |
| AD-67607.1 | 94.42 | 35.45 | 121.14 | 19.57 |
| AD-67571.1 | 112.27 | 26.92 | 120.03 | 21.17 |
| AD-67599.1 | 171.97 | 24.42 | 113.09 | 20.69 |
| AD-67554.1 | 125.76 | 26.14 | 118.60 | 35.12 |
| AD-67549.1 | 119.56 | 65.06 | 150.20 | 16.69 |
| AD-67567.1 | 133.44 | 93.04 | 144.51 | 44.20 |
| AD-67558.1 | 158.66 | 58.69 | 115.42 | 22.09 |
| AD-67569.1 | 123.35 | 42.23 | 150.79 | 30.96 |
| AD-67548.1 | 130.24 | 31.18 | 126.72 | 29.14 |
| AD-67566.1 | 97.88 | 15.18 | 161.34 | 45.64 |
| AD-67613.1 | 133.15 | 53.50 | 164.06 | 35.86 |
| AD-67610.1 | 125.68 | 41.94 | 123.89 | 17.82 |
| AD-67556.1 | 129.25 | 45.87 | 156.50 | 34.41 |
| AD-67581.1 | 81.75 | 13.75 | 127.10 | 26.78 |
| AD-67560.1 | 119.69 | 56.51 | 127.65 | 12.06 |
| AD-67596.1 | 104.08 | 30.46 | 128.33 | 24.04 |
| AD-67557.1 | 78.91 | 9.50 | 127.50 | 9.39 |
| AD-67584.1 | 131.87 | 19.40 | 128.29 | 20.96 |
| AD-67575.1 | 124.30 | 43.53 | 151.26 | 44.05 |
| AD-67605.1 | 122.92 | 37.28 | 120.37 | 16.17 |
| AD-67562.1 | 124.35 | 35.73 | 109.59 | 17.85 |
| AD-67606.1 | 160.77 | 45.92 | 152.73 | 33.64 |
| AD-67604.1 | 111.98 | 13.56 | 167.29 | 31.28 |
| AD-67565.1 | 135.81 | 13.80 | 120.59 | 16.82 |
| AD-67529.1 | 38.14 | 15.75 | 121.25 | 64.05 |
| AD-67533.1 | 12.73 | 5.26 | 16.84 | 7.89 |
| AD-67537.1 | 86.70 | 19.46 | 92.22 | 10.90 |
| AD-67546.1 | 51.08 | 19.80 | 93.17 | 14.25 |
| AD-67547.1 | 23.08 | 14.10 | 64.05 | 22.49 |
| AD-67543.1 | 79.50 | 28.07 | 111.48 | 34.28 |
| AD-67541.1 | 18.70 | 11.01 | 55.21 | 13.26 |
| AD-67535.1 | 36.56 | 12.86 | 93.32 | 28.28 |
| AD-67530.1 | 33.36 | 9.33 | 41.89 | 15.37 |
| AD-67542.1 | 23.31 | 7.40 | 84.60 | 16.44 |
| AD-67528.1 | 17.24 | 5.43 | 27.71 | 5.90 |
| AD-67527.1 | 19.79 | 1.80 | 37.50 | 17.14 |
| AD-67544.1 | 11.14 | 3.90 | 24.01 | 9.11 |
| AD-67532.1 | 19.67 | 6.21 | 45.02 | 22.68 |
| AD-67534.1 | 15.07 | 3.74 | 42.41 | 21.95 |
| AD-67538.1 | 10.11 | 1.51 | 46.11 | 9.50 |
| AD-67545.1 | 24.38 | 5.53 | 69.48 | 8.00 |
| AD-67539.1 | 27.60 | 4.13 | 80.14 | 19.65 |
| AD-67540.1 | 19.25 | 4.32 | 64.45 | 17.14 |
| AD-67531.1 | 33.63 | 15.63 | 50.55 | 16.20 |
| AD-67536.1 | 10.87 | 5.44 | 39.87 | 14.64 |

TABLE 14

Mouse PNPLA3 endogenous in vitro dose response screen

| Duplex Name | $IC_{50}$ (nM) |
|---|---|
| AD-67525.1 | n/a |
| AD-67526.1 | n/a |
| AD-67527.1 | 2.309 |
| AD-67528.1 | 0.673 |
| AD-67530.1 | 0.921 |
| AD-67531.1 | 0.581 |
| AD-67532.1 | 1.425 |
| AD-67533.1 | 0.567 |
| AD-67534.1 | 4.128 |
| AD-67536.1 | 2.288 |
| AD-67538.1 | 0.538 |
| AD-67544.1 | 0.608 |
| AD-67577.1 | n/a |
| AD-67578.1 | n/a |

TABLE 15

Human PNPLA3 Dual-Glo ® in vitro 10 nM and 0.1 nM single dose screen

| Duplex Name | 10 nM_AVG | 10 nM_STDEV | 0.1 nM_AVG | 0.1 nM_STDEV |
|---|---|---|---|---|
| AD-67524.1 | 55.85 | 7.32 | 102.37 | 32.69 |
| AD-67611.1 | 107.30 | 22.70 | 97.85 | 2.28 |
| AD-67601.1 | 95.78 | 11.23 | 85.88 | 29.26 |
| AD-67579.1 | 77.51 | 8.06 | 101.67 | 36.37 |
| AD-67588.1 | 47.11 | 6.33 | 89.10 | 18.85 |
| AD-67602.1 | 77.70 | 12.22 | 81.37 | 13.84 |
| AD-67570.1 | 48.66 | 10.55 | 68.57 | 28.45 |
| AD-67553.1 | 44.56 | 7.76 | 93.93 | 38.43 |
| AD-67612.1 | 38.37 | 0.82 | 75.31 | 20.53 |
| AD-67525.1 | 29.59 | 9.56 | 62.31 | 9.28 |
| AD-67526.1 | 53.90 | 3.79 | 70.76 | 15.61 |
| AD-67592.1 | 52.84 | 10.35 | 98.32 | 32.26 |
| AD-67578.1 | 53.64 | 4.02 | 64.89 | 13.47 |
| AD-67555.1 | 56.39 | 10.80 | 69.54 | 19.05 |
| AD-67577.1 | 48.65 | 10.91 | 54.23 | 6.43 |
| AD-67594.1 | 74.48 | 1.78 | 93.18 | 24.59 |
| AD-67568.1 | 45.05 | 1.82 | 92.90 | 28.78 |
| AD-67550.1 | 44.13 | 4.53 | 68.69 | 20.38 |
| AD-67586.1 | 64.19 | 5.26 | 84.24 | 40.47 |
| AD-67576.1 | 79.72 | 15.25 | 82.61 | 35.92 |
| AD-67563.1 | 29.23 | 4.19 | 59.00 | 12.91 |
| AD-67552.1 | 54.78 | 11.92 | 79.03 | 16.42 |
| AD-67608.1 | 57.15 | 4.59 | 77.51 | 11.84 |
| AD-67593.1 | 101.86 | 11.04 | 96.29 | 17.81 |
| AD-67609.1 | 122.26 | 11.52 | 128.58 | 16.30 |
| AD-67597.1 | 62.83 | 5.62 | 101.58 | 38.86 |
| AD-67587.1 | 57.38 | 14.11 | 105.10 | 27.16 |
| AD-67559.1 | 51.66 | 5.22 | 91.89 | 14.10 |
| AD-67561.1 | 51.41 | 3.67 | 71.48 | 29.44 |
| AD-67551.1 | 34.40 | 1.24 | 49.32 | 10.41 |
| AD-67591.1 | 60.13 | 3.19 | 90.29 | 18.00 |
| AD-67583.1 | 36.86 | 2.53 | 93.04 | 25.60 |
| AD-67585.1 | 53.41 | 8.56 | 79.44 | 18.57 |
| AD-67589.1 | 37.94 | 7.73 | 75.57 | 10.11 |
| AD-67595.1 | 75.77 | 8.06 | 90.18 | 31.68 |
| AD-67580.1 | 71.41 | 1.40 | 74.67 | 23.67 |
| AD-67573.1 | 70.86 | 4.99 | 84.53 | 20.34 |
| AD-67600.1 | 72.31 | 16.88 | 78.24 | 10.32 |
| AD-67603.1 | 75.73 | 13.27 | 83.86 | 13.43 |
| AD-67598.1 | 77.98 | 14.11 | 86.38 | 27.50 |
| AD-67564.1 | 75.61 | 4.75 | 112.02 | 16.56 |
| AD-67574.1 | 60.65 | 11.08 | 83.89 | 27.59 |
| AD-67590.1 | 58.37 | 10.03 | 73.59 | 23.40 |
| AD-67572.1 | 96.15 | 19.05 | 99.37 | 14.65 |
| AD-67582.1 | 35.14 | 4.73 | 61.85 | 10.01 |
| AD-67607.1 | 35.55 | 8.50 | 66.52 | 7.13 |
| AD-67571.1 | 87.08 | 10.17 | 90.89 | 10.55 |
| AD-67599.1 | 102.26 | 6.41 | 94.34 | 3.26 |
| AD-67554.1 | 47.64 | 4.28 | 69.79 | 12.50 |

TABLE 15-continued

Human PNPLA3 Dual-Glo ® in vitro
10 nM and 0.1 nM single dose screen

| Duplex Name | 10 nM_AVG | 10 nM_STDEV | 0.1 nM_AVG | 0.1 nM_STDEV |
|---|---|---|---|---|
| AD-67549.1 | 27.66 | 2.50 | 51.69 | 14.59 |
| AD-67567.1 | 37.31 | 6.07 | 64.11 | 19.16 |
| AD-67558.1 | 30.72 | 4.79 | 72.23 | 22.28 |
| AD-67569.1 | 36.42 | 1.62 | 68.82 | 8.06 |
| AD-67548.1 | 59.63 | 13.22 | 94.53 | 28.41 |
| AD-67566.1 | 54.82 | 11.76 | 58.13 | 29.99 |
| AD-67613.1 | 70.40 | 10.36 | 69.65 | 14.48 |
| AD-67610.1 | 75.42 | 12.56 | 83.75 | 10.26 |
| AD-67556.1 | 84.41 | 2.30 | 91.86 | 36.53 |
| AD-67581.1 | 53.86 | 14.24 | 100.03 | 42.15 |
| AD-67560.1 | 40.96 | 10.50 | 64.75 | 25.60 |
| AD-67596.1 | 75.01 | 9.11 | 99.67 | 17.69 |
| AD-67557.1 | 46.45 | 5.85 | 82.71 | 7.14 |
| AD-67584.1 | 30.32 | 1.09 | 29.60 | 4.38 |
| AD-67575.1 | 18.95 | 5.11 | 34.22 | 7.00 |
| AD-67605.1 | 18.06 | 8.25 | 31.33 | 15.81 |
| AD-67562.1 | 53.05 | 12.05 | 65.06 | 24.50 |
| AD-67606.1 | 27.53 | 7.98 | 44.22 | 17.40 |
| AD-67604.1 | 51.35 | 1.71 | 78.70 | 19.78 |
| AD-67565.1 | 19.72 | 1.66 | 44.43 | 16.60 |

TABLE 16

Human PNPLA3 Dual-Glo ® in vitro dose response screen

| Duplex Name | IC$_{50}$ (nM) |
|---|---|
| AD-67584.1 | 0.1149 |
| AD-67605.1 | 0.0915 |
| AD-67575.1 | 0.1616 |
| AD-67606.1 | 0.5824 |
| AD-67565.1 | 0.1988 |
| AD-67551.1 | 0.6022 |
| AD-67549.1 | 0.7905 |

Example 4. In Vivo Effect of Single Dose Administration of PNPLA3 iRNA Agent

Ob/ob mice strongly express PNPLA3 in the liver. Accordingly, Ob/ob mice (B6.Cg-Lepob/J) were administered a single subcutaneous dose of 0.3 mg/kg, 1.5 mg/kg, or 3.0 mg/kg, or PBS alone as a control, of AD-67525, AD-67526, AD-67528, AD-65731, AD67533, AD-67538, or AD-67544. The animals were sacrificed and the livers were excised 96 hours post-dose and the level of PNPLA3 mRNA was quantified by RT-qPCR.

As shown in FIG. 1, AD-65726 administered as a single 1.5. mg/kg dose, or AD-67533 administered as a single 3.0 mg/kg dose exhibited the most robust suppression of hepatic PNPLA3 of the agents and doses assayed.

EQUIVALENTS

Those skilled in the art will recognize, or be able to ascertain using no more than routine experimentation, many equivalents to the specific embodiments and methods described herein. Such equivalents are intended to be encompassed by the scope of the following claims.

SEQUENCE LISTING (1659 sequences)

SEQ ID NO: 1 - DNA, 2805 bp, Homo sapiens
atggtccgaggggggcggggctgacgtcgcgctgggaatgccctggccgagacactgaggcagggtagagagcgcttgcgggcgccgggcggagctgctgcggatcaggacccgagccgattcccgatcccgacccagatcctaacccgcgcccccgccccgccgccgccgccatgtacgacgcagagcgcggctggagcttgtccttcgcgggctgcggcttcctgggcttctaccacgtcggggcgacccgctgcctgagcgagcacgccccgcacctcctccgcgacgcgcgcatgttgttcggcgcttcggccggggcgttgcactgcgtcggcgtcctctccggtatcccgctggagcagactctgcaggtcctctcagatcttgtgcggaaggccaggagtcggaacattggcatcttccatccatccttcaacttaagcaagttcctccgacagggtctctgcaaatgcctcccggccaatgtccaccagctcatctccggcaaaataggcatctctcttaccagagtgtctgatggggaaaacgttctggtgtctgactttcggtccaaagacgaagtcgtggatgccttggtatgttcctgcttcatccccttctacagtggccttatccctccttccttcagaggcgtgcgatatgtggatggaggagtgagtgacaacgtacccttcattgatgccaaaacaaccatcaccgtgtcccccttctatggggagtacgacatctgccctaaagtcaagtccacgaactttcttcatgtggacatcaccaagctcagtctacgcctctgcacagggaacctctaccttctctcgagagcttttgtccccccggatctcaaggtgctgggagagatatgccttcgaggatatttggatgcattcaggttcttggaagagaagggcatctgcaacaggccccagccaggcctgaagtcatcctcagaagggatggatcctgaggtcgccatgcccagctgggcaaacatgagtctggattcttccccggagtcggctgccttggctgtgaggctggagggagatgagctgctagaccacctgcgtctcagcatcctgccctgggatgagagcatcctggacaccctctcgcccaggctcgctacagcactgagtgaagaaatgaaagacaaaggtggatacatgagcaagatttgcaacttgctacccattaggataatgtcttatgtaatgctgccctgtaccctgcctgtggaatctgccattgcgattgtccagagactggtgacatggcttccagatatgcccgacgatgtcctgtggttgcagtgggtgacctcacaggtgttcactcgagtgctgatgtgtctgctccccgcctccaggtcccaaatgccagtgagcagccaacaggcctccccatgcacacctgagcaggactggccctgctggactccctgctcccccaagggctgtccagcagagaccaaagcagaggccaccccgcggtccatcctcaggtccagcctgaacttcttcttgggcaataaagtacctgctggtgctgaggggctctccacctttcccagtttttcactagagaagagtctgtgagtcacttgaggaggcgagtctagcagattctttcagaggtgctaaagtttcccatctttgtgcagctacctccgcattgctgtgtagtgacccctgcctgtgacgtggaggatcccagcctctgagctgagttggttttatgaaaagctaggaagcaacctttcgcctgtgcagcggtccagcacttaactctaatacatcagcatgcgttaattcagctggttgggaaatgacaccaggaagcccagtgcagagggtcccttactgactgtttcgtggccctattaatggtcagactgttccagcatgaggttcttagaatgacaggtgtttggatgggtgggggccttgtgatggggggtaggctggcccatgtgtgatcttgtggggtggagggaagagaatagcatgatcccacttccccatgctgtgggaaggggtgcagttcgtccccaagaacgacactgcctgtcaggtggtctgcaaagatgataaccttgactactaaaaacgtctccatggcgggggtaacaagatgataatctacttaattttagaacacctttttcacctaactaaaataatgtttaaagagttttgtataaaaatgtaaggaagcgttgttacctgttgaattttgtattatgtgaatcagtgagatgttagtagaataagccttaaaaaaaaaaaaatcggttgggtgcagtggcacacggctgtaatcccagcactttgggaggccaaggttggcagatcacctgaggtcaggagttcaagaccagtctggccaacatagcaaaaccctgtctctactaaaaatacaaaaattatctgggcatggtggtgcatgcctgtaatcccagctattcggaaggctgaggcaggagaatcacttgaacccaggaggcggaggttgcggtgagctgagattgcaccatttcattccagcctgggcaacatgagtgaaagtctgactcaaaaaaaaaaaatttaaaaaacaaaataatctagtgtgcagggcattcacctcagccccccaggcaggagccaagcacagcaggagcttccgcctcctctccactggagcacacaacttgaacctggcttattttctgcagggaccagccccacatggtcagtgagtttctccccatgtgtggcgatgagagagtgtagaaataaagac

SEQ ID NO: 2 - DNA, 2805 bp, Homo sapiens
gtctttatttctacactctctcatcgccacacatggggagaaactcactgaccatgtggggctggtccctgcagaaaataagccaggttcaagttgtgtgctccagtggagaggaggcggaagctcctgctgtgcttggctcctgcctggggggctgaggtgaatgccctgcacactagattattttgttttttaaattttttttttttgagtcagactttcactcatgttgcccaggctggaatgaaatggtgcaatctcagctcaccgcaacctccgcctcctgggttcaagtgattctcctgcctcagccttccgaatagctgggattacaggcatgcaccaccatgcccagataatttttgtatttttagtagagacagggttttgctatgttggccagactggtcttgaactcctgacctcaggtgatctgccaaccttggcctcccaaagtgctgggattacagccgtgtgccactgcacccaaccgatttttttttttttaaggcttattctactaacatctcactgattcacataatacaaaattcaacaggtaacaacgcttccttacatttttatacaaaactctttaaacattattttagttaggtgaaaaaggtgttctaaaattaagtagattatcatcttgttacccccgccatggagacgtttttagtagtcaaggttatcatctttgcagaccacctgacaggcagtgtcgttcttggggacgaactgcaccccttcccacagcatggggaagtgggatcatgctattctcttccctccaccccacaagatcacacatgggccagcctaccccccatcacaaggcccccacccatccaaacacctgtcattctaagaacctcatgctggaacagtctgaccattaatagggccacgaaacagtcagtaagggaccctctgcactgggcttcctggtgtcatttcccaaccagctgaattaacgcatgctgatgtattagagttaagtgctggaccgctgcacaggcgaaaggttgcttcctagcttttcataaaaccaactcagctcagaggctgggatcctccacgtcacaggcaggggtcactacacagcaatgcggaggtagctgcacaaagatgggaaactttagcacctctgaaagaatctgctagactcgcctcctcaagtgactcacagactcttctctagtgaaaaactgggaaaggtggagagcccctcagcaccagcaggtactttattgcccaagaagaagttcaggctggacctgaggatggaccgcggggtggcctctgctttggtctctgctggacagcccttgggggagcagggagtccagcagggccagtcctgctcaggtgtgcatggggaggcctgttggctgctcactggcatttgggacctggaggcggggagcagacacatcagcactcgagtgaacacctgtgaggtcacccactgcaaccacaggacatcgtcgggcatatctggaagccatgtcaccagtctctggacaatcgcaatggcagattccacaggcagggtacagggcagcattacataagacattatcctaatgggtagcaagttgcaaatcttgctcatgtatccacctttgtctttcatttcttcactcagtgctgtagcgagcctgggcgagagggtgtccaggatgctctcatcccagggcaggatgctgagacgcaggtggtctagcagctcatctccctccagcctcacagccaaggcagccgactccggggaagaatccagactcatgtttgcccagctgggcatggcgacctcaggatccatcccttctgaggatgacttcaggcctggctggggcctgttgcagatgcccttctcttccaagaacctgaatgcatccaaatatcctcgaaggcatatctctcccagcaccttgagatccggggggacaaaagctctcgagagaaggtagaggttccctgtgcagaggcgtagactgagcttggtgatgtccacatgaagaaagttcgtggacttgactttagggcagatgtcgtactccccatagaagggggacacggtgatggttgttttggcatcaatgaagggtacgttgtcactcactcctccatccacatatcgcacgcctctgaaggaaggagggataaggccactgtagaaggggatgaagcaggaacataccaaggcatccacgacttcgtctttggaccgaaagtcagacaccagaacgttttccccatcagacactctggtaagagagatgcctattttgccggagatgagctggtggacattggccgggaggcatttgcagagaccctgtcggaggaacttgcttaagttgaaggatggatggaagatgccaatgttccgactcctggccttccgcacaagatctgagaggacctgcagagtctgctccagcgggataccggagaggacgccgacgcagtgcaacgccccggccgaagcgccgaacaacatgcgcgcgtcgcggaggaggtgcggggcgtgctcgctcaggcagcgggtcgccccgacgtggtagaagcccaggaagccgcagcccgcgaaggacaagctccagccgcgctctgcgtcgtacatggcggcggcggcggggcgggggcgcgggttaggatctgggtcgggatcgggaatcggctcgggtcctgatccgcagcagctccgcccggcgcccgcaagcgctctctaccctgcctcagtgtctcggccagggcattcccagcgcgacgtcagccccgcccccctcggaccat

SEQ ID NO: 3 - DNA, 4649 bp, Mus musculus
agagcagcaacaccgggagcagagctgaactgcagcgccgcccggagcttcaagcaccatgtatgacccagagcgccgctggagcctgtcgtttgcaggctgcggcttcctgggcttctaccacgtcggggctacgctatgtctgagcgagcgcgccccgcacctcctccgcgatgcgcgcactttctttggctgctcggccggtgcactgcacgcggtcaccttcgtgtgcagtctccctctcggccgtataatggagatcctcatggacctcgtgcggaaagccaggagccgcaacatcggcaccctccacccgttcttcaacattaacaagtgcatcagagacgggctccaggagagcctcccagacaatgtccaccaggtcatttctggcaaggttcacatctcactcaccagggtgtcggatggggagaacgtgctggtgtctgagttccattccaaagacgaagtcgtggatgccctggtgtgttcctgcttcattcccctcttctctggcctaatccctccttccttccgaggcgagcggtacgtggacggaggagtgagcgacaacgtccctgtgctggatgccaaaaccaccatcacggtgtcacctttctacggtgagcatgacatctgccccaaagtcaagtccaccaacttcttccacgtgaatatcaccaacctcagcctccgcctctgcactgggaacctccaacttctgaccagagcgctcttcccgtctgatgtgaaggtgatgggagagctgtgctatcaagggtacctggacgccttccggttcctggaggagaatggcatctgtaacgggccacagcgcagcctgagtctgtccttggtggcgccagaagcctgcttggaaaatggcaaacttgtgggagacaaggtgccagtcagcctatgctttacagatgagaacatctgggagacactgtcccccgagctcagcacagctctgagtgaagcgattaaggacagggagggctacctgagcaaagtctgcaacctcctgcccgtcaggatcctgtcctacatcatgctgccctgcagtctgcccgtggagtcggctatcgctgcagtccacaggctggtgacatggctccctgatatccaggatgatatccagtggctacaatgggcgacatcccaggtttgtgcccgaatgacgatgtgcctgctcccctctaccaggtaaatacttgggcccagggtgtgtgggccagataggcatccctcccggttgttcccagagctcttagggtcagagcttgggtggtgacagccttaacaagccaggctcagccgcctgtccccagcatgccattaaagaaaccggtagcagagaaagcaggtttattcgaatataaaaaggttcaagcccccacccggttaatctttaagataccaacaggaggcttaagtttaaacagagttacacataaacagtctgaatcagggcgtggtcctgcccaccattgtctgggcttcaaggttccttctttctctccctagcatgagattcctgggacaatcccaattccttggcctccattgtatcaaagggctgaaaaccaaagggaaggcacagctgtctcttcagcatgcctcttctgccagaaccactgcaaggtttggtgctcaggctgtgcaaacattctagcaatgtttgactcagtgtcaagcaggtgacaaggaacatggtgctgtgtggggggaacccatggcccaggtgagggcttattggtgggtgaagctgtgggtgttcaggtggtggagaaggccttaagggatgggactgacacctcagcactgaaggcaggaggaagctgtggctctgggttgcacccctgcctggctccaccctctctggcatctgtagaagttacagctggttcttcctctcagccccatgctcccagaaataagactcagacccaaattatagttacaaataccttggccatatagctaggctcttctcagactagctcataacttaactcattaattttaacctccatcctgccacatggctggtggcctgtgctcaggtaccatgagtccagctcttcacatctttccggatgaatcttccataattctttctgcctcctggatgttccaccttctattccaccttttcctataggccatggttttgtttttgttttttttttccaaatttaatttaattaattaatttatttatttttggtttttcgagacagggtttctctgtatcgccctggctgtcctggaactcactatgtaagccaggctggcctcaaactcagaaatccgcctgcctctgcctcctgagtgctgggattaaaggcgtgcgcaaccatgcccggtgtggtttttttttttttttaattgacaggtggatgcatctatataatccataacatattctctctacaggtatctattaggttttgggtgaggtgtggagttctagggaactctgagagaaattcctggggagtaagtggtttatcaagttgattggaggagtttttaatgctatggacagacagacagaaggacaacagcatagtcggggctaccagggagttcaggccccggcatcggagatagaagcaggatggggtctttgaagagattctgagcccacacagcagaggagggactctctctttagagcttttgaggatgagggaggttgactgcaagagcctacagccaggctcgaggcaggcagggggtggggagcaggatgtaaaccccttcgatgctgacagactcacttctggggtaaaatattatgagatgcctgtcagtgtctgtgaagagacctgagcagagtctggattctgacatcaatcatgttcttacaatactgaagacctgagagcctgcaatcttggtttgtaaattgctggtctccgtgcttccagtgaacttggacattcttctcatggttggtccaggagaggccaaagctgagggcaccctgccttccacccccagtccagcttgaccttttatctggagcaacagtgtctagatgatgggtgggtgaggggtgctatactgtctgtccctctgggaagggttctgttacttttggaggcagctaggaagtttctctgtgcagctgccccctggtgctgtgtggtgacctcattgcctgtgaccccaggatcacaggatctgggctaaagtggtagtccatagaaaccaaagacaatgatttggtgtttagaaagctactcttggtctgggtgaagtctggtgcttaagggctatcacaaagagcgtgtcaaaccatctctcagcctgtgagtcagtggggagcccaagggcatcagtgtttggaaactggaatccaaaccgggcaatctcggaaggaaactgtttaggaattgtgatgggacgggccgtggctgtctctgaaaagggcctgccagataacttattacttttaaggacacctttggctcttactaatttataaagcattttatataaacacaccagggagtgcatggtgaactacacgtatgatcagttaagtggggctagaattaggtagggagagcatcggacctctgcctcctcaacctcaacttgcttgctttctccactggctccaaatctttgtatagtcatcagccatgaccacctctctccctccccatctactaccagcagcgttaatgggaataagtacccacttctctcaggtgtactatacagctgtgggtgtggtgtgtgtttcctgtaattcacactttagaaaggaaacaagcaaacaaaagaaaccaggtgctgcccatactcctaagtgtagacagtgaaggtgtgtgtctcccatgcctgagtctcctggaggcctagtgagctccaggttcatgcaagcacatcaggaggaatcatataatctcagcacggttgatccagatgggataagaaaggactctgggagagagaatgtggttctagagacaaagtgtctaggctacacagaagataagactgtcccaaggaaagaaaagaaaccaggaactagggtgcagctcagttgtcagaggacttctctaggcttgaagcccagagtccaatctcagcaccttataaactgtggagtgacaggcagtgacatcggcctgtaatcccaacactcaagcagtagaggcaagaggatcataagttcaaggtcttccttggctatttagggagttggaggttagctctggctacatgagaccctgtctcaaaaaaaaaaaaaaaaaaaagtagaaacttctgccttgctttgagctgcccctttctggacgtttctcatcagtagagaatattcctgccaccctatcagacaaaactcccactggtttggagtctctccattctcaggaacacctcaggagtcagacagtgagcagcagggagcaatgtcttgacttgtaagccccttagcaaggctggttcatttgtttattaaaagcaggtgtgggtgaatttatgcaaatgagtatgcaaactagtggaacagcagaaggattgaatggatacaccaaaaataaccacaactgtttaagggaaaagggtccataataaatgtggggaacaaaaaacaaataaatgtgattttttttagaaaaatg

SEQ ID NO: 4 - DNA, 4649 bp, Mus musculus
catttttctaaaaaaaatcacatttatttgttttttgttccccacatttattatggacccttttcccttaaacagttgtggttatttttggtgtatccattcaatccttctgctgttccactagtttgcatactcatttgcataaattcacccacacctgcttttaataaacaaatgaaccagccttgctaaggggcttacaagtcaagacattgctccctgctgctcactgtctgactcctgaggtgttcctgagaatggagagactccaaaccagtgggagttttgtctgatagggtggcaggaatattctctactgatgagaaacgtccagaaaggggcagctcaaagcaaggcagaagtttctacttttttttttttttttttttgagacagggtctcatgtagccagagctaacctccaactccctaaatagccaaggaagaccttgaacttatgatcctcttgcctctactgcttgagtgttgggattacaggccgatgtcactgcctgtcactccacagtttataaggtgctgagattggactctgggcttcaagcctagagaagtcctctgacaactgagctgcaccctagttcctggtttcttttctttccttgggacagtcttatcttctgtgtagcctagacactttgtctctagaaccacattctctctcccagagtcctttcttatcccatctggatcaaccgtgctgagattatatgattcctcctgatgtgcttgcatgaacctggagctcactaggcctccaggagactcaggcatgggagacacacaccttcactgtctacacttaggagtatgggcagcacctggtttcttttgtttgcttgtttcctttctaaagtgtgaattacaggaaacacacaccacacccacagctgtatagtacacctgagagaagtgggtacttattcccattaacgctgctggtagtagatggggagggagagaggtggtcatggctgatgactatacaaagatttggagccagtggagaaagcaagcaagttgaggttgaggaggcagaggtccgatgctctccctacctaattctagccccacttaactgatcatacgtgtagttcaccatgcactccctggtgtgtttatataaaatgctttataaattagtaagagccaaaggtgtccttaaaagtaataagttatctggcaggcccttttcagagacagccacggcccgtcccatcacaattcctaaacagtttccttccgagattgcccggtttggattccagtttccaaacactgatgcccttgggctccccactgactcacaggctgagagatggtttgacacgctctttgtgatagcccttaagcaccagacttcacccagaccaagagtagctttctaaacaccaaatcattgtctttggtttctatggactaccactttagcccagatcctgtgatcctggggtcacaggcaatgaggtcaccacacagcaccagggggcagctgcacagagaaacttcctagctgcctccaaaagtaacagaacccttcccagagggacagacagtatagcacccctcacccacccatcatctagacactgttgctccagataaaaggtcaagctggactgggggtggaaggcagggtgccctcagctttggcctctcctggaccaaccatgagaagaatgtccaagttcactggaagcacggagaccagcaatttacaaaccaagattgcaggctctcaggtcttcagtattgtaagaacatgattgatgtcagaatccagactctgctcaggtctcttcacagacactgacaggcatctcataatattttaccccagaagtgagtctgtcagcatcgaaggggtttacatcctgctccccaccccctgcctgcctcgagcctggctgtaggctcttgcagtcaacctccctcatcctcaaaagctctaaagagagagtccctcctctgctgtgtgggctcagaatctcttcaaagaccccatcctgcttctatctccgatgccggggcctgaactccctggtagccccgactatgctgttgtccttctgtctgtctgtccatagcattaaaaactcctccaatcaacttgataaaccacttactccccaggaatttctctcagagttccctagaactccacacctcacccaaaacctaatagatacctgtagagagaatatgttatggattatatagatgcatccacctgtcaattaaaaaaaaaaaaaaaccacaccgggcatggttgcgcacgcctttaatcccagcactcaggaggcagaggcaggcggatttctgagtttgaggccagcctggcttacatagtgagttccaggacagccagggcgatacagagaaaccctgtctcgaaaaaccaaaaataaataaattaattaattaaattaaatttggaaaaaaaaaacaaaaacaaaaccatggcctataggaaaaggtggaatagaaggtggaacatccaggaggcagaaagaattatggaagattcatccggaaagatgtgaagagctggactcatggtacctgagcacaggccaccagccatgtggcaggatggaggttaaaattaatgagttaagttatgagctagtctgagaagagcctagctatatggccaaggtatttgtaactataatttgggtctgagtcttatttctgggagcatggggctgagaggaagaaccagctgtaacttctacagatgccagagagggtggagccaggcaggggtgcaacccagagccacagcttcctcctgccttcagtgctgaggtgtcagtcccatcccttaaggccttctccaccacctgaacacccacagcttcacccaccaataagccctcacctgggccatgggttccccccacacagcaccatgttccttgtcacctgcttgacactgagtcaaacattgctagaatgtttgcacagcctgagcaccaaaccttgcagtggttctggcagaagaggcatgctgaagagacagctgtgccttccctttggttttcagccctttgatacaatggaggccaaggaattgggattgtcccaggaatctcatgctagggagagaaagaaggaaccttgaagcccagacaatggtgggcaggaccacgccctgattcagactgtttatgtgtaactctgtttaaacttaagcctcctgttggtatcttaaagattaaccgggtgggggcttgaacctttttatattcgaataaacctgctttctctgctaccggtttctttaatggcatgctggggacaggcggctgagcctggcttgttaaggctgtcaccacccaagctctgaccctaagagctctgggaacaaccgggagggatgcctatctggcccacacaccctgggcccaagtatttacctggtagaggggagcaggcacatcgtcattcgggcacaaacctgggatgtcgcccattgtagccactggatatcatcctggatatcagggagccatgtcaccagcctgtggactgcagcgatagccgactccacgggcagactgcagggcagcatgatgtaggacaggatcctgacgggcaggaggttgcagactttgctcaggtagccctccctgtccttaatcgcttcactcagagctgtgctgagctcgggggacagtgtctcccagatgttctcatctgtaaagcataggctgactggcaccttgtctcccacaagtttgccattttccaagcaggcttctggcgccaccaaggacagactcaggctgcgctgtggcccgttacagatgccattctcctccaggaaccggaaggcgtccaggtacccttgatagcacagctctcccatcaccttcacatcagacgggaagagcgctctggtcagaagttggaggttcccagtgcagaggcggaggctgaggttggtgatattcacgtggaagaagttggtggacttgactttggggcagatgtcatgctcaccgtagaaaggtgacaccgtgatggtggttttggcatccagcacagggacgttgtcgctcactcctccgtccacgtaccgctcgcctcggaaggaaggagggattaggccagagaagaggggaatgaagcaggaacacaccagggcatccacgacttcgtctttggaatggaactcagacaccagcacgttctccccatccgacaccctggtgagtgagatgtgaaccttgccagaaatgacctggtggacattgtctgggaggctctcctggagcccgtctctgatgcacttgttaatgttgaagaacgggtggagggtgccgatgttgcggctcctggctttccgcacgaggtccatgaggatctccattatacggccgagagggagactgcacacgaaggtgaccgcgtgcagtgcaccggccgagcagccaaagaaagtgcgcgcatcgcggaggaggtgcggggcgcgctcgctcagacatagcgtagccccgacgtggtagaagcccaggaagccgcagcctgcaaacgacaggctccagcggcgctctgggtcatacatggtgcttgaagctccgggcggcgctgcagttcagctctgctcccggtgttgctgctct

SEQ ID NO: 5 - DNA, 2759 bp, Rattus norvegicus
cccggagcagaattgagctgcatcgccttccggagcctccagcgccatgtacgacccagagcgccgctggagcctgtcgttcgcaggctgcggcttcctaggcttctaccacatcggggctacgctatgtctgagcgagcgcgctccgcacatcctccgcgaagcgcgcactttcttcggctgctcggccggtgcactgcacgcggtcaccttcgtgtgcagtctccctctcgatcacatcatggagatcctcatggacctcgtgcggaaagccaggagccgcaacatcggcaccctccacccgttcttcaacattaacaagtgcgtcagagacggccttcaggagaccctcccagacaacgtccaccagatcatttctggcaaggtttacatctcactcaccagagtgtccgatggggagaacgtgctggtgtctgagttccattccaaagacgaagtggtggatgccctggtgtgctcctgcttcattcctctcttctctggcctaatccctccttccttccgaggtgagcggtacgtggatggaggagtgagtgacaacgtccctgtgctggacgccaaaaccaccatcacggtgtcccctttctatggtgagcatgacatctgtcccaaagtgaagtccaccaacttcctccaggtgaatatcaccaacctcagtcttcgtctctgcactgggaaccttcatcttctgaccagagcactcttcccatctgatgtgaaggtgatgggagagctgtgctttcaagggtacctggacgccttccggttcctggaagagaacggcatctgtaatgggccacagcgcagcctgagtctgtccttggagaaggaaatggcgccagaaaccatgataccctgcttggaaaatggccaccttgtagcagggaacaaggtgccagtaagctgtgtatgccttacagctgtgccgtcggatgagagcatctgggagatgctgtcccccaagctcagcacagctctgactgaagcgattaaagacagggggggctacctgaacaaagtctgcaacctcctgcccattaggatcctgtcctacatcttgctgccctgcactctgcccgtggagtcggccatcgctgcagtccacaggctggtgatgtggctccctgatatccatgaagatatccagtggctacagtgggcaacatcccaggtgtgtgcccgaatgaccatgtgcctgctcccctctaccagatccagagcatccaaggataaccatcaaacactcaagcatggatatcacccatctctccacaaaccccaaggcagctctgccggtttgtaaattgctggtctccgtgcttccgatgaacttgggcattctccctgtggatggttccaggagaggccatagctgaaggcactctgccttccaccccaagtccagtttgacctttatctagagcaacagtgtctagatgataggtgggtggggggtgctgtctctctgtttccctctgggaagggttctgttaacttttggaggcagctaggaaatttctctccaggagctgagcctgtgcagctgcccccttggtgctgtgtggtaacctcattgcctgtgaccctaggatcataggatctgggctaaataggtagttcatagaaaccaaagacaataatttggtgtttagaaaactacttttggtctgggtgaagtctggtgcttgagagttagtgcagagagaacggtcaaaccgtctctcagcctgtggatctatggggattccaagggcttcagtgtttggaaacggcaatccaaacgggcaatcttgtgcaatcttggaaggagaactgttcaggaagtgtgatgggatgagctgtggctgtctctgaaaagggcctaccatataacttattactttcaaggatacctttggctcttactaaaatagtttataaagcattttatagaaacacaccagggaatgcgtggtgaactacatgtatgatcagtgaactgtgactagaattaaccttaaaatctcttgtatgtggggccagagcaacacaggtgggaaacgcagcggacctctgcctcctcggcctcaacatgaacttggcttgctttctccaccgtctccaaatctttgtatagtcatcgaccattaccacctctcctttcccatctactacagcagccttaatggggataagtacccccttttctcaggtgtccgaataagctgtgggtgtggcctgtgtttcctgtaattctgaggttagattggaacataagcaagcagacaaacaagcagacaaacaaacaaggttctactcatattcctaagcagtgacagtgaaggcatgtgtctcccatgcctgagtctcctagggtcctagtgagctctgggttcatgcaagcacttccggaggaattgcaccctccatggaacacataatctccactgggttgatcctgattggataagaaaggatctcggggagagaatgtggttccagaggcaaagtgtctaggctacacagaaaaggtaagactgtccccaagggaagaaaacaaactgggagctggggtccagctcaattgttaagagtgcttctctagtatgcgtgaagcccagagtccaatctcagtaccagatacacggtacaggcagtgacatatgcctgtaatcccaaccctcaagcagtagaggcaagaggatcagaagttcatggtcatccttgactacttatacttagggagttggaggtcagcc

SEQ ID NO: 6 - DNA, 2759 bp, Rattus norvegicus
ggctgacctccaactccctaagtataagtagtcaaggatgaccatgaacttctgatcctcttgcctctactgcttgagggttgggattacaggcatatgtcactgcctgtaccgtgtatctggtactgagattggactctgggcttcacgcatactagagaagcactcttaacaattgagctggaccccagctcccagtttgttttcttcccttggggacagtcttaccttttctgtgtagcctagacactttgcctctggaaccacattctctccccgagatcctttcttatccaatcaggatcaacccagtggagattatgtgttccatggagggtgcaattcctccggaagtgcttgcatgaacccagagctcactaggaccctaggagactcaggcatgggagacacatgccttcactgtcactgcttaggaatatgagtagaaccttgtttgtttgtctgcttgtttgtctgcttgcttatgttccaatctaacctcagaattacaggaaacacaggccacacccacagcttattcggacacctgagaaaagggggtacttatccccattaaggctgctgtagtagatgggaaaggagaggtggtaatggtcgatgactatacaaagatttggagacggtggagaaagcaagccaagttcatgttgaggccgaggaggcagaggtccgctgcgtttcccacctgtgttgctctggccccacatacaagagattttaaggttaattctagtcacagttcactgatcatacatgtagttcaccacgcattccctggtgtgtttctataaaatgctttataaactattttagtaagagccaaaggtatccttgaaagtaataagttatatggtaggcccttttcagagacagccacagctcatcccatcacacttcctgaacagttctccttccaagattgcacaagattgcccgtttggattgccgtttccaaacactgaagcccttggaatccccatagatccacaggctgagagacggtttgaccgttctctctgcactaactctcaagcaccagacttcacccagaccaaaagtagttttctaaacaccaaattattgtctttggtttctatgaactacctatttagcccagatcctatgatcctagggtcacaggcaatgaggttaccacacagcaccaagggggcagctgcacaggctcagctcctggagagaaatttcctagctgcctccaaaagttaacagaacccttcccagagggaaacagagagacagcaccccccacccacctatcatctagacactgttgctctagataaaggtcaaactggacttggggtggaaggcagagtgccttcagctatggcctctcctggaaccatccacagggagaatgcccaagttcatcggaagcacggagaccagcaatttacaaaccggcagagctgccttggggtttgtggagagatgggtgatatccatgcttgagtgtttgatggttatccttggatgctctggatctggtagaggggagcaggcacatggtcattcgggcacacacctgggatgttgcccactgtagccactggatatcttcatggatatcagggagccacatcaccagcctgtggactgcagcgatggccgactccacgggcagagtgcagggcagcaagatgtaggacaggatcctaatgggcaggaggttgcagactttgttcaggtagccccccctgtctttaatcgcttcagtcagagctgtgctgagcttgggggacagcatctcccagatgctctcatccgacggcacagctgtaaggcatacacagcttactggcaccttgttccctgctacaaggtggccattttccaagcagggtatcatggtttctggcgccatttccttctccaaggacagactcaggctgcgctgtggcccattacagatgccgttctcttccaggaaccggaaggcgtccaggtacccttgaaagcacagctctcccatcaccttcacatcagatgggaagagtgctctggtcagaagatgaaggttcccagtgcagagacgaagactgaggttggtgatattcacctggaggaagttggtggacttcactttgggacagatgtcatgctcaccatagaaaggggacaccgtgatggtggttttggcgtccagcacagggacgttgtcactcactcctccatccacgtaccgctcacctcggaaggaaggagggattaggccagagaagagaggaatgaagcaggagcacaccagggcatccaccacttcgtctttggaatggaactcagacaccagcacgttctccccatcggacactctggtgagtgagatgtaaaccttgccagaaatgatctggtggacgttgtctgggagggtctcctgaaggccgtctctgacgcacttgttaatgttgaagaacgggtggagggtgccgatgttgcggctcctggctttccgcacgaggtccatgaggatctccatgatgtgatcgagagggagactgcacacgaaggtgaccgcgtgcagtgcaccggccgagcagccgaagaaagtgcgcgcttcgcggaggatgtgcggagcgcgctcgctcagacatagcgtagccccgatgtggtagaagcctaggaagccgcagcctgcgaacgacaggctccagcggcgctctgggtcgtacatggcgctggaggctccggaaggcgatgcagctcaattctgctccggg

SEQ ID NO: 7 - DNA, 2281 bp, Macaca fascicularis
tgctgcggatcaggacccgagccgatccccgatcccgactccgatccggatccgcgcccccgcccccgccccgccatgtacgacgccgagcgcggctggagcttgtccttcgcgggctgcggcttcctgggcttctaccacgtcggggcgacccggtgcctgagcgagcacgccccgcacctcctccgcgacgcgcgcatgttgttcggcgcctcggccggggcgttgcactgcgtcggcgtcctctccgggatcccgctggagcagactctgcaggtcctctcagatcttgtccggaaggccaggagtcggaacattggtatcttccatccatccttcaacataggcaagttcctccgacaggatctctacaaatacctcccggccaatgtccaccagctcatctctggcaaaatatgcgtctcactcaccagagtgtctgatggggaaaacgttctggtgtctgactttcagtccaaagacgaagtcgtggatgccttgatttgttcctgcttcatccctttctacagtggccttatccctccttccttcagaggcgtgcgatatgtggatggaggagcgagtgacaacgtacccttcattgatgccaagacaaccatcaccgtgtcgcccttctatggggagtacgacatctgccctaaagtcaagtccaccaactttcttcatgtggacatcaccaagctcagcctacgcctctgcacagggaacctctaccttctctcaagagcgtttgtccccccggatctcaaggtgctgggagagatatgccttcgaggatatttggacgcgttcaggttcttggaagagaagggcatctgcaacaagccccagcggggtctgaagtcatcctcagaagggatggattctgaggtcactgcgcccggctgggaaaacacaagtctggattcttccccggagccggctgccttggctatgaggctggatggagatgagctgctagaccacctgcgtctcagcatcctgccctgggatgagagcatcctggacaccctgtcgcccgagctcgctacagcagtgagtgaagcaatgaaagacaaaggtggatacatgagcaagatttgcaacttgctacccattaggataatatcttatgtgatgctgccctgtaccctgcctgtggagtctgccattgcgattgtccagagactggtgacatggcttccagatatgcccgacgatgtgcagtggctgcagtgggtgacctcacaggtcttcactcgagcgctgatgtgtctgcttcccgcctccaggtcccaaatgccagtgagcagcgaacaggcctccccatgcaaaccggagcaggactggcactgctggactccctgctcccccgaggactgtcctgcagaggccaaagcagaggctaccccacggtccatcctcaggtccagcctgaacttcttctggggcaataaagtacctgctggtgctgaggggctctccacctttcccagtttttcactggagaagaatttgtgagtcatttgaggaggcgagtctaggagattctttcagaggtgctaaagcttcccatctttgtgcagctacctccgcattgccgtgtagtgacccctgcctgtgacgtggaggatcccagcctctgagctgagttggttttatgaaaagctaggaagcaatgtttggtctgtgcagcagtccagcacttaagtctaatacgtcagcatgcgttagttcagctggttgggaaatgacaccgggaagcctagcgcagagggtcccttactgactatttcatggtcctattaatggtcagactgttccagtgtgaggttcttagaatgactagtgtttggatgggtgggggccttgtggtggggggtgggctggcctatgtgtgatcttgtggggtggaaggaagagagtagcacaatcccacctccccatgccgtgggaaggggtgcacttggttcccaagaaggacactgcctgtcaggtggcctgcaaatataataaccttgacaactaaaaacctctccatgggggtgggaggtaccaagataataaccgatttacattttagagcacctttttcacctaactaaaataatgtttaaagagttttatataaaaatgtaaggaagagttgttatctgttgaattttgtattatatgaatcagtgagatgttaatagaataagcctttaaaaagaaaaaaagttcagccaggcgctgtggcacacgcctgtaatcccagcactttggaaggccgaggtgggca

SEQ ID NO: 8 - DNA, 2281 bp, Macaca fascicularis
tgcccacctcggccttccaaagtgctgggattacaggcgtgtgccacagcgcctggctgaactttttttctttttaaaggcttattctattaacatctcactgattcatataatacaaaattcaacagataacaactcttccttacatttttatataaaactctttaaacattattttagttaggtgaaaaaggtgctctaaaatgtaaatcggttattatcttggtacctcccacccccatggagaggtttttagttgtcaaggttattatatttgcaggccacctgacaggcagtgtccttcttgggaaccaagtgcaccccttcccacggcatggggaggtgggattgtgctactctcttccttccaccccacaagatcacacataggccagcccaccccccaccacaaggcccccacccatccaaacactagtcattctaagaacctcacactggaacagtctgaccattaataggaccatgaaatagtcagtaagggaccctctgcgctaggcttcccggtgtcatttcccaaccagctgaactaacgcatgctgacgtattagacttaagtgctggactgctgcacagaccaaacattgcttcctagcttttcataaaaccaactcagctcagaggctgggatcctccacgtcacaggcaggggtcactacacggcaatgcggaggtagctgcacaaagatgggaagctttagcacctctgaaagaatctcctagactcgcctcctcaaatgactcacaaattcttctccagtgaaaaactgggaaaggtggagagcccctcagcaccagcaggtactttattgccccagaagaagttcaggctggacctgaggatggaccgtggggtagcctctgctttggcctctgcaggacagtcctcgggggagcagggagtccagcagtgccagtcctgctccggtttgcatggggaggcctgttcgctgctcactggcatttgggacctggaggcgggaagcagacacatcagcgctcgagtgaagacctgtgaggtcacccactgcagccactgcacatcgtcgggcatatctggaagccatgtcaccagtctctggacaatcgcaatggcagactccacaggcagggtacagggcagcatcacataagatattatcctaatgggtagcaagttgcaaatcttgctcatgtatccacctttgtctttcattgcttcactcactgctgtagcgagctcgggcgacagggtgtccaggatgctctcatcccagggcaggatgctgagacgcaggtggtctagcagctcatctccatccagcctcatagccaaggcagccggctccggggaagaatccagacttgtgttttcccagccgggcgcagtgacctcagaatccatcccttctgaggatgacttcagaccccgctggggcttgttgcagatgcccttctcttccaagaacctgaacgcgtccaaatatcctcgaaggcatatctctcccagcaccttgagatccggggggacaaacgctcttgagagaaggtagaggttccctgtgcagaggcgtaggctgagcttggtgatgtccacatgaagaaagttggtggacttgactttagggcagatgtcgtactccccatagaagggcgacacggtgatggttgtcttggcatcaatgaagggtacgttgtcactcgctcctccatccacatatcgcacgcctctgaaggaaggagggataaggccactgtagaaagggatgaagcaggaacaaatcaaggcatccacgacttcgtctttggactgaaagtcagacaccagaacgttttccccatcagacactctggtgagtgagacgcatattttgccagagatgagctggtggacattggccgggaggtatttgtagagatcctgtcggaggaacttgcctatgttgaaggatggatggaagataccaatgttccgactcctggccttccggacaagatctgagaggacctgcagagtctgctccagcgggatcccggagaggacgccgacgcagtgcaacgccccggccgaggcgccgaacaacatgcgcgcgtcgcggaggaggtgcggggcgtgctcgctcaggcaccgggtcgccccgacgtggtagaagcccaggaagccgcagcccgcgaaggacaagctccagccgcgctcggcgtcgtacatggcggggcgggggcgggggcgcggatccggatcggagtcgggatcggggatcggctcgggtcctgatccgcagca

SEQ ID NO: 9 - DNA, 1544 bp, Macaca mulatta
cgcttgcgggcgcccggcggagctgctgcggatcaggacccgagccgatccccgatcccgactccgatccggatccgcgcccccgcccccgccccgccatgtacgacgccgagcgcggctggagcttgtccttcgcgggctgcggcttcctgggcttctaccacgtcggggcgacccgctgcctgagcgagcacgccccgcacctcctccgcgacgcgcgcatgttgttcggcgcctcggccggggcgttgcactgcgtcggcgtcctctccgggatcccgctggagcagactctgcaggtcctctcagatcttgtccggaaggccaggagtcggaacattggtatcttccatccatccttcaacataggcaagttcctccgacaggatctctacaaatacctcccggccaatgtccaccagctcatctctggcaaaatatgcgtctcactcaccagagtgtctgatggggaaaacgttctggtgtctgactttcagtccaaagacgaagtcgtggatgccttgatttgttcctgcttcatccctttctacagtggccttatccctccttccttcagaggcgtgcgatatgtggatggaggagcgagtgacaacgtacccttcattgatgccaagacaaccatcaccgtgtcgcccttctatggggagtacgacatctgccctaaagtcaagtccaccaactttcttcatgtggacatcaccaagctcagcctacgcctctgcacagggaacctctaccttctctcaagagcgtttgtccccccggatctcaaggtgctgggagagatatgccttcgaggatatttggacgcgttcaggttcttggaagagaagggcatctgcaacaagccccagcggggtctgaagtcatcctcagaagggatggattctgaggtcactgcgcccggctgggaaaacacaagtctggattcttccccggagccggctgccttggctatgaggctggatggagatgagctgctagaccacctgcgtctcagcatcctgccctgggatgagagcatcctggacaccctgtcgcccgagctcgctacagcagtgagtgaagcaatgaaagacaaaggtggatacatgagcaagatttgcaacttgctacccattaggataatgtcttatgtgatgctgccctgtaccctgcctgtggagtctgccattgcgattgtccagagactggtgacatggcttccggatatgcccgacgatgtgcagtggctgcagtgggtgacctcacaggtcttcactcgagcgctgatgtgtctgcttcccgcctccaggtcccaaatgccagtgagcggcgaacaggcctccccatgcaaaccggagcaggactggcactgctggactccctgctcccccgaggactgtcctgcagaggccaaagcagaggctaccccacggtccatcctcaggtccagcctgaacttcttctggggcaataaagtacctgctggtgctgaggggctctccacctttcccagtttttcactggagaagaatttgtga

SEQ ID NO: 10 - DNA, 1544 bp, Macaca mulatta
tcacaaattcttctccagtgaaaaactgggaaaggtggagagcccctcagcaccagcaggtactttattgccccagaagaagttcaggctggacctgaggatggaccgtggggtagcctctgctttggcctctgcaggacagtcctcgggggagcagggagtccagcagtgccagtcctgctccggtttgcatggggaggcctgttcgccgctcactggcatttgggacctggaggcgggaagcagacacatcagcgctcgagtgaagacctgtgaggtcacccactgcagccactgcacatcgtcgggcatatccggaagccatgtcaccagtctctggacaatcgcaatggcagactccacaggcagggtacagggcagcatcacataagacattatcctaatgggtagcaagttgcaaatcttgctcatgtatccacctttgtctttcattgcttcactcactgctgtagcgagctcgggcgacagggtgtccaggatgctctcatcccagggcaggatgctgagacgcaggtggtctagcagctcatctccatccagcctcatagccaaggcagccggctccggggaagaatccagacttgtgttttcccagccgggcgcagtgacctcagaatccatcccttctgaggatgacttcagaccccgctggggcttgttgcagatgcccttctcttccaagaacctgaacgcgtccaaatatcctcgaaggcatatctctcccagcaccttgagatccggggggacaaacgctcttgagagaaggtagaggttccctgtgcagaggcgtaggctgagcttggtgatgtccacatgaagaaagttggtggacttgactttagggcagatgtcgtactccccatagaagggcgacacggtgatggttgtcttggcatcaatgaagggtacgttgtcactcgctcctccatccacatatcgcacgcctctgaaggaaggagggataaggccactgtagaaagggatgaagcaggaacaaatcaaggcatccacgacttcgtctttggactgaaagtcagacaccagaacgttttccccatcagacactctggtgagtgagacgcatattttgccagagatgagctggtggacattggccgggaggtatttgtagagatcctgtcggaggaacttgcctatgttgaaggatggatggaagataccaatgttccgactcctggccttccggacaagatctgagaggacctgcagagtctgctccagcgggatcccggagaggacgccgacgcagtgcaacgccccggccgaggcgccgaacaacatgcgcgcgtcgcggaggaggtgcggggcgtgctcgctcaggcagcgggtcgccccgacgtggtagaagcccaggaagccgcagcccgcgaaggacaagctccagccgcgctcggcgtcgtacatggcggggcgggggcgggggcgcggatccggatcggagtcgggatcggggatcggctcgggtcctgatccgcagcagctccgccgggcgcccgcaagcg

SEQ ID NO: 11 - DNA, 1495 bp, Macaca fascicularis
gctgctgcggatcaggacccgagccgatccccgatcccgactccgatccggatccgcgcccccgcccccgccccgccatgtacgacgccgagcgcggctggagcttgtccttcgcgggctgcggcttcctgggcttctaccacgtcggggcgacccggtgcctgagcgagcacgccccgcacctcctccgcgacgcgcgcatgttgttcggcgcctcggccggggcgttgcactgcgtcggcgtcctctccgggatcccgctggagcagactctgcaggtcctctcagatcttgtccggaaggccaggagtcggaacattggtatcttccatccatccttcaacataggcaagttcctccgacaggatctctacaaatacctcccggccaatgtccaccagctcatctctggcaaaatatgcgtctcactcaccagagtgtctgatggggaaaacgttctggtgtctgactttcagtccaaagacgaagtcgtggatgccttgatttgttcctgcttcatccctttctacagtggccttatccctccttccttcagaggcgtgcgatatgtggatggaggagcgagtgacaacgtacccttcattgatgccaagacaaccatcaccgtgtcgcccttctatggggagtacgacatctgccctaaagtcaagtccaccaactttcttcatgtggacatcaccaagctcagcctacgcctctgcacagggaacctctaccttctctcaagagcgtttgtccccccggatctcaaggtgctgggagagatatgccttcgaggatatttggacgcgttcaggttcttggaagagaagggcatctgcaacaagccccagcggggtctgaagtcatcctcagaagggatggattctgaggtcactgcgcccggctgggaaaacacaagtctggattcttccccggagccggctgccttggctatgaggctggatggagatgagctgctagaccacctgcgtctcagcatcctgccctgggatgagagcatcctggacaccctgtcgcccgagctcgctacagcagtgagtgaagcaatgaaagacaaaggtggatacatgagcaagatttgcaacttgctacccattaggataatatcttatgtgatgctgccctgtaccctgcctgtggagtctgccattgcgattgtccagagtgtaagtcctttgagctttcttgaaccagaagtggcctcattttgctttagagatttcagatgggctcatccttgtcctgtcatcccagatccacctgctgggaagtcatcagattggagatgatgttggcggcttttgtaaacaaagggtggtgttgtaagctgttgtgtctgcctgtgtgtgtgtttgtgtacttggtcttatctctgcagactggtgacatggcttccagatatgcccgacgatgtgcagtggctgcagtgggtgacctcacaggtcttcactcgagcgctgatgtgtctgct

SEQ ID NO: 12 - DNA, 1495 bp, Macaca fascicularis
agcagacacatcagcgctcgagtgaagacctgtgaggtcacccactgcagccactgcacatcgtcgggcatatctggaagccatgtcaccagtctgcagagataagaccaagtacacaaacacacacacaggcagacacaacagcttacaacaccaccctttgtttacaaaagccgccaacatcatctccaatctgatgacttcccagcaggtggatctgggatgacaggacaaggatgagcccatctgaaatctctaaagcaaaatgaggccacttctggttcaagaaagctcaaaggacttacactctggacaatcgcaatggcagactccacaggcagggtacagggcagcatcacataagatattatcctaatgggtagcaagttgcaaatcttgctcatgtatccacctttgtctttcattgcttcactcactgctgtagcgagctcgggcgacagggtgtccaggatgctctcatcccagggcaggatgctgagacgcaggtggtctagcagctcatctccatccagcctcatagccaaggcagccggctccggggaagaatccagacttgtgttttcccagccgggcgcagtgacctcagaatccatcccttctgaggatgacttcagaccccgctggggcttgttgcagatgcccttctcttccaagaacctgaacgcgtccaaatatcctcgaaggcatatctctcccagcaccttgagatccggggggacaaacgctcttgagagaaggtagaggttccctgtgcagaggcgtaggctgagcttggtgatgtccacatgaagaaagttggtggacttgactttagggcagatgtcgtactccccatagaagggcgacacggtgatggttgtcttggcatcaatgaagggtacgttgtcactcgctcctccatccacatatcgcacgcctctgaaggaaggagggataaggccactgtagaaagggatgaagcaggaacaaatcaaggcatccacgacttcgtctttggactgaaagtcagacaccagaacgttttccccatcagacactctggtgagtgagacgcatattttgccagagatgagctggtggacattggccgggaggtatttgtagagatcctgtcggaggaacttgcctatgttgaaggatggatggaagataccaatgttccgactcctggccttccggacaagatctgagaggacctgcagagtctgctccagcgggatcccggagaggacgccgacgcagtgcaacgccccggccgaggcgccgaacaacatgcgcgcgtcgcggaggaggtgcggggcgtgctcgctcaggcaccgggtcgccccgacgtggtagaagcccaggaagccgcagcccgcgaaggacaagctccagccgcgctcggcgtcgtacatggcggggcgggggcgggggcgcggatccggatcggagtcgggatcggggatcggctcgggtcctgatccgcagcagc

SEQ ID NO: 13 - protein, 16 aa, Unknown
  source: /note="Description of Unknown: RFGF peptide"
AAVALLPAVLLALLAP

SEQ ID NO: 14 - protein, 11 aa, Unknown
  source: /note="Description of Unknown: RFGF analogue peptide"
AALLPVLLAAP

SEQ ID NO: 15 - protein, 13 aa, Human immunodeficiency virus
GRKKRRQRRRPPQ

SEQ ID NO: 16 - protein, 16 aa, Drosophila sp.
RQIKIWFQNRRMKWKK

SEQ ID NO: 17 - skipped

SEQ ID NO: 18 - DNA, 2821 bp, Homo sapiens
gcgatcgcatggtccgaggggggcggggctgacgtcgcgctgggaatgccctggccgagacactgaggcagggtagagagcgcttgcgggcgccgggcggagctgctgcggatcaggacccgagccgattcccgatcccgacccagatcctaacccgcgcccccgccccgccgccgccgccatgtacgacgcagagcgcggctggagcttgtccttcgcgggctgcggcttcctgggcttctaccacgtcggggcgacccgctgcctgagcgagcacgccccgcacctcctccgcgacgcgcgcatgttgttcggcgcttcggccggggcgttgcactgcgtcggcgtcctctccggtatcccgctggagcagactctgcaggtcctctcagatcttgtgcggaaggccaggagtcggaacattggcatcttccatccatccttcaacttaagcaagttcctccgacagggtctctgcaaatgcctcccggccaatgtccaccagctcatctccggcaaaataggcatctctcttaccagagtgtctgatggggaaaacgttctggtgtctgactttcggtccaaagacgaagtcgtggatgccttggtatgttcctgcttcatccccttctacagtggccttatccctccttccttcagaggcgtgcgatatgtggatggaggagtgagtgacaacgtacccttcattgatgccaaaacaaccatcaccgtgtcccccttctatggggagtacgacatctgccctaaagtcaagtccacgaactttcttcatgtggacatcaccaagctcagtctacgcctctgcacagggaacctctaccttctctcgagagcttttgtccccccggatctcaaggtgctgggagagatatgccttcgaggatatttggatgcattcaggttcttggaagagaagggcatctgcaacaggccccagccaggcctgaagtcatcctcagaagggatggatcctgaggtcgccatgcccagctgggcaaacatgagtctggattcttccccggagtcggctgccttggctgtgaggctggagggagatgagctgctagaccacctgcgtctcagcatcctgccctgggatgagagcatcctggacaccctctcgcccaggctcgctacagcactgagtgaagaaatgaaagacaaaggtggatacatgagcaagatttgcaacttgctacccattaggataatgtcttatgtaatgctgccctgtaccctgcctgtggaatctgccattgcgattgtccagagactggtgacatggcttccagatatgcccgacgatgtcctgtggttgcagtgggtgacctcacaggtgttcactcgagtgctgatgtgtctgctccccgcctccaggtcccaaatgccagtgagcagccaacaggcctccccatgcacacctgagcaggactggccctgctggactccctgctcccccaagggctgtccagcagagaccaaagcagaggccaccccgcggtccatcctcaggtccagcctgaacttcttcttgggcaataaagtacctgctggtgctgaggggctctccacctttcccagtttttcactagagaagagtctgtgagtcacttgaggaggcgagtctagcagattctttcagaggtgctaaagtttcccatctttgtgcagctacctccgcattgctgtgtagtgacccctgcctgtgacgtggaggatcccagcctctgagctgagttggttttatgaaaagctaggaagcaacctttcgcctgtgcagcggtccagcacttaactctaatacatcagcatgcgttaattcagctggttgggaaatgacaccaggaagcccagtgcagagggtcccttactgactgtttcgtggccctattaatggtcagactgttccagcatgaggttcttagaatgacaggtgtttggatgggtgggggccttgtgatggggggtaggctggcccatgtgtgatcttgtggggtggagggaagagaatagcatgatcccacttccccatgctgtgggaaggggtgcagttcgtccccaagaacgacactgcctgtcaggtggtctgcaaagatgataaccttgactactaaaaacgtctccatggcgggggtaacaagatgataatctacttaattttagaacacctttttcacctaactaaaataatgtttaaagagttttgtataaaaatgtaaggaagcgttgttacctgttgaattttgtattatgtgaatcagtgagatgttagtagaataagccttaaaaaaaaaaaaatcggttgggtgcagtggcacacggctgtaatcccagcactttgggaggccaaggttggcagatcacctgaggtcaggagttcaagaccagtctggccaacatagcaaaaccctgtctctactaaaaatacaaaaattatctgggcatggtggtgcatgcctgtaatcccagctattcggaaggctgaggcaggagaatcacttgaacccaggaggcggaggttgcggtgagctgagattgcaccatttcattccagcctgggcaacatgagtgaaagtctgactcaaaaaaaaaaaatttaaaaaacaaaataatctagtgtgcagggcattcacctcagccccccaggcaggagccaagcacagcaggagcttccgcctcctctccactggagcacacaacttgaacctggcttattttctgcagggaccagccccacatggtcagtgagtttctccccatgtgtggcgatgagagagtgtagaaataaagacgcggccgc

SEQ ID NO: 19 - RNA, 21 nt, Artificial Sequence
  source: /note="Description of Artificial Sequence: Synthetic oligonucleotide"
ggcuuccugggcuucuaccaa

SEQ ID NO: 20 - RNA, 21 nt, Artificial Sequence
  source: /note="Description of Artificial Sequence: Synthetic oligonucleotide"
uauaauggagauccucaugga

SEQ ID NO: 21 - RNA, 21 nt, Artificial Sequence
  source: /note="Description of Artificial Sequence: Synthetic oligonucleotide"
uugugcggaaggccaggagua

SEQ ID NO: 22 - RNA, 21 nt, Artificial Sequence
  source: /note="Description of Artificial Sequence: Synthetic oligonucleotide"
aaggccaggagucggaacauu

SEQ ID NO: 23 - RNA, 21 nt, Artificial Sequence
  source: /note="Description of Artificial Sequence: Synthetic oligonucleotide"
aggccaggagucggaacauua

SEQ ID NO: 24 - RNA, 21 nt, Artificial Sequence
  source: /note="Description of Artificial Sequence: Synthetic oligonucleotide"
gugucugaguuccauuccaaa

SEQ ID NO: 25 - RNA, 21 nt, Artificial Sequence
  source: /note="Description of Artificial Sequence: Synthetic oligonucleotide"
agucguggaugcccuggugua

SEQ ID NO: 26 - RNA, 21 nt, Artificial Sequence
  source: /note="Description of Artificial Sequence: Synthetic oligonucleotide"
aacguucuggugucugacuuu

SEQ ID NO: 27 - RNA, 21 nt, Artificial Sequence
  source: /note="Description of Artificial Sequence: Synthetic oligonucleotide"
cugacuuucgguccaaagaca

SEQ ID NO: 28 - RNA, 21 nt, Artificial Sequence
  source: /note="Description of Artificial Sequence: Synthetic oligonucleotide"
ucgguccaaagacgaagucgu

SEQ ID NO: 29 - RNA, 21 nt, Artificial Sequence
  source: /note="Description of Artificial Sequence: Synthetic oligonucleotide"
cgguccaaagacgaagucgua

SEQ ID NO: 30 - RNA, 21 nt, Artificial Sequence
  source: /note="Description of Artificial Sequence: Synthetic oligonucleotide"
gacgaagucguggaugccuua

SEQ ID NO: 31 - RNA, 21 nt, Artificial Sequence
  source: /note="Description of Artificial Sequence: Synthetic oligonucleotide"
cuugguauguuccugcuucau

SEQ ID NO: 32 - RNA, 21 nt, Artificial Sequence
  source: /note="Description of Artificial Sequence: Synthetic oligonucleotide"
ggccuuaucccuccuuccuua

SEQ ID NO: 33 - RNA, 21 nt, Artificial Sequence
  source: /note="Description of Artificial Sequence: Synthetic oligonucleotide"
aggagugagugacaacguaca

SEQ ID NO: 34 - RNA, 21 nt, Artificial Sequence
  source: /note="Description of Artificial Sequence: Synthetic oligonucleotide"
gugagugacaacguacccuua

SEQ ID NO: 35 - RNA, 21 nt, Artificial Sequence
  source: /note="Description of Artificial Sequence: Synthetic oligonucleotide"
ugaugccaaaacaaccaucaa

SEQ ID NO: 36 - RNA, 21 nt, Artificial Sequence
  source: /note="Description of Artificial Sequence: Synthetic oligonucleotide"
cgacaucugcccuaaagucaa

SEQ ID NO: 37 - RNA, 21 nt, Artificial Sequence
  source: /note="Description of Artificial Sequence: Synthetic oligonucleotide"
ugcuaucaaggguaccuggaa

SEQ ID NO: 38 - RNA, 21 nt, Artificial Sequence
  source: /note="Description of Artificial Sequence: Synthetic oligonucleotide"
acgaacuuucuucauguggaa

SEQ ID NO: 39 - RNA, 21 nt, Artificial Sequence
  source: /note="Description of Artificial Sequence: Synthetic oligonucleotide"
gcacagggaaccucuaccuua

SEQ ID NO: 40 - RNA, 21 nt, Artificial Sequence
  source: /note="Description of Artificial Sequence: Synthetic oligonucleotide"
ugcugggagagauaugccuua

SEQ ID NO: 41 - RNA, 21 nt, Artificial Sequence
  source: /note="Description of Artificial Sequence: Synthetic oligonucleotide"
ugggagagauaugccuucgaa

SEQ ID NO: 42 - RNA, 21 nt, Artificial Sequence
  source: /note="Description of Artificial Sequence: Synthetic oligonucleotide"
agagauaugccuucgaggaua

SEQ ID NO: 43 - RNA, 21 nt, Artificial Sequence
  source: /note="Description of Artificial Sequence: Synthetic oligonucleotide"
auaugccuucgaggauauuua

SEQ ID NO: 44 - RNA, 21 nt, Artificial Sequence
  source: /note="Description of Artificial Sequence: Synthetic oligonucleotide"
ugccuucgaggauauuuggau

SEQ ID NO: 45 - RNA, 21 nt, Artificial Sequence
  source: /note="Description of Artificial Sequence: Synthetic oligonucleotide"
auucagguucuuggaagagaa

SEQ ID NO: 46 - RNA, 21 nt, Artificial Sequence
  source: /note="Description of Artificial Sequence: Synthetic oligonucleotide"
cauccucagaagggauggaua

SEQ ID NO: 47 - RNA, 21 nt, Artificial Sequence
  source: /note="Description of Artificial Sequence: Synthetic oligonucleotide"
ccugcccugggaugagagcau

SEQ ID NO: 48 - RNA, 21 nt, Artificial Sequence
  source: /note="Description of Artificial Sequence: Synthetic oligonucleotide"
ucccagguuugugcccgaaua

SEQ ID NO: 49 - RNA, 21 nt, Artificial Sequence
  source: /note="Description of Artificial Sequence: Synthetic oligonucleotide"
ccagguuugugcccgaaugaa

SEQ ID NO: 50 - RNA, 21 nt, Artificial Sequence
  source: /note="Description of Artificial Sequence: Synthetic oligonucleotide"
gacaaagguggauacaugaga

SEQ ID NO: 51 - RNA, 21 nt, Artificial Sequence
  source: /note="Description of Artificial Sequence: Synthetic oligonucleotide"
aaagguggauacaugagcaaa

SEQ ID NO: 52 - RNA, 21 nt, Artificial Sequence
  source: /note="Description of Artificial Sequence: Synthetic oligonucleotide"
guggauacaugagcaagauuu

SEQ ID NO: 53 - RNA, 21 nt, Artificial Sequence
  source: /note="Description of Artificial Sequence: Synthetic oligonucleotide"
uggauacaugagcaagauuua

SEQ ID NO: 54 - RNA, 21 nt, Artificial Sequence
  source: /note="Description of Artificial Sequence: Synthetic oligonucleotide"
auacaugagcaagauuugcaa

SEQ ID NO: 55 - RNA, 21 nt, Artificial Sequence
  source: /note="Description of Artificial Sequence: Synthetic oligonucleotide"
agcaagauuugcaacuugcua

SEQ ID NO: 56 - RNA, 21 nt, Artificial Sequence
  source: /note="Description of Artificial Sequence: Synthetic oligonucleotide"
caagauuugcaacuugcuaca

SEQ ID NO: 57 - RNA, 21 nt, Artificial Sequence
  source: /note="Description of Artificial Sequence: Synthetic oligonucleotide"
gauuugcaacuugcuacccau

SEQ ID NO: 58 - RNA, 21 nt, Artificial Sequence
  source: /note="Description of Artificial Sequence: Synthetic oligonucleotide"
ugcaacuugcuacccauuaga

SEQ ID NO: 59 - RNA, 21 nt, Artificial Sequence
  source: /note="Description of Artificial Sequence: Synthetic oligonucleotide"
aacuugcuacccauuaggaua

SEQ ID NO: 60 - RNA, 21 nt, Artificial Sequence
  source: /note="Description of Artificial Sequence: Synthetic oligonucleotide"
gccauugcgauuguccagaga

SEQ ID NO: 61 - RNA, 21 nt, Artificial Sequence
  source: /note="Description of Artificial Sequence: Synthetic oligonucleotide"
gauuguccagagacuggugaa

SEQ ID NO: 62 - RNA, 21 nt, Artificial Sequence
  source: /note="Description of Artificial Sequence: Synthetic oligonucleotide"
uggugacauggcuuccagaua

SEQ ID NO: 63 - RNA, 21 nt, Artificial Sequence
  source: /note="Description of Artificial Sequence: Synthetic oligonucleotide"
ccagauaugcccgacgaugua

SEQ ID NO: 64 - RNA, 21 nt, Artificial Sequence
  source: /note="Description of Artificial Sequence: Synthetic oligonucleotide"
gugguugcagugggugaccua

SEQ ID NO: 65 - RNA, 21 nt, Artificial Sequence
  source: /note="Description of Artificial Sequence: Synthetic oligonucleotide"
aggucccaaaugccagugaga

SEQ ID NO: 66 - RNA, 21 nt, Artificial Sequence
  source: /note="Description of Artificial Sequence: Synthetic oligonucleotide"
ucacuugaggaggcgagucua

SEQ ID NO: 67 - RNA, 21 nt, Artificial Sequence
  source: /note="Description of Artificial Sequence: Synthetic oligonucleotide"
agucuagcagauucuuucaga

SEQ ID NO: 68 - RNA, 21 nt, Artificial Sequence
  source: /note="Description of Artificial Sequence: Synthetic oligonucleotide"
auucuuucagaggugcuaaaa

SEQ ID NO: 69 - RNA, 21 nt, Artificial Sequence
  source: /note="Description of Artificial Sequence: Synthetic oligonucleotide"
uucuuucagaggugcuaaagu

SEQ ID NO: 70 - RNA, 21 nt, Artificial Sequence
  source: /note="Description of Artificial Sequence: Synthetic oligonucleotide"
gugcuaaaguuucccaucuuu

SEQ ID NO: 71 - RNA, 21 nt, Artificial Sequence
  source: /note="Description of Artificial Sequence: Synthetic oligonucleotide"
ucccaucuuugugcagcuaca

SEQ ID NO: 72 - RNA, 21 nt, Artificial Sequence
  source: /note="Description of Artificial Sequence: Synthetic oligonucleotide"
cugccugugacguggaggaua

SEQ ID NO: 73 - RNA, 21 nt, Artificial Sequence
  source: /note="Description of Artificial Sequence: Synthetic oligonucleotide"
ugugacguggaggaucccaga

SEQ ID NO: 74 - RNA, 21 nt, Artificial Sequence
  source: /note="Description of Artificial Sequence: Synthetic oligonucleotide"
ucugagcugaguugguuuuau

SEQ ID NO: 75 - RNA, 21 nt, Artificial Sequence
  source: /note="Description of Artificial Sequence: Synthetic oligonucleotide"
cugagcugaguugguuuuaua

SEQ ID NO: 76 - RNA, 21 nt, Artificial Sequence
  source: /note="Description of Artificial Sequence: Synthetic oligonucleotide"
aguugguuuuaugaaaagcua

SEQ ID NO: 77 - RNA, 21 nt, Artificial Sequence
  source: /note="Description of Artificial Sequence: Synthetic oligonucleotide"
uugguuuuaugaaaagcuaga

SEQ ID NO: 78 - RNA, 21 nt, Artificial Sequence
  source: /note="Description of Artificial Sequence: Synthetic oligonucleotide"
gguuuuaugaaaagcuaggaa

SEQ ID NO: 79 - RNA, 21 nt, Artificial Sequence
  source: /note="Description of Artificial Sequence: Synthetic oligonucleotide"
guuuuaugaaaagcuaggaaa

SEQ ID NO: 80 - RNA, 21 nt, Artificial Sequence
  source: /note="Description of Artificial Sequence: Synthetic oligonucleotide"
uuuuaugaaaagcuaggaaga

SEQ ID NO: 81 - RNA, 21 nt, Artificial Sequence
  source: /note="Description of Artificial Sequence: Synthetic oligonucleotide"
uaugaaaagcuaggaagcaaa

SEQ ID NO: 82 - RNA, 21 nt, Artificial Sequence
  source: /note="Description of Artificial Sequence: Synthetic oligonucleotide"
cguuaauucagcugguuggga

SEQ ID NO: 83 - RNA, 21 nt, Artificial Sequence
  source: /note="Description of Artificial Sequence: Synthetic oligonucleotide"
guuaauucagcugguugggaa

SEQ ID NO: 84 - RNA, 21 nt, Artificial Sequence
  source: /note="Description of Artificial Sequence: Synthetic oligonucleotide"
agcugguugggaaaugacaca

SEQ ID NO: 85 - RNA, 21 nt, Artificial Sequence
  source: /note="Description of Artificial Sequence: Synthetic oligonucleotide"
ccuauuaauggucagacuguu

SEQ ID NO: 86 - RNA, 21 nt, Artificial Sequence
  source: /note="Description of Artificial Sequence: Synthetic oligonucleotide"
cuauuaauggucagacuguua

SEQ ID NO: 87 - RNA, 21 nt, Artificial Sequence
  source: /note="Description of Artificial Sequence: Synthetic oligonucleotide"
gcuggcccaugugugaucuua

SEQ ID NO: 88 - RNA, 21 nt, Artificial Sequence
  source: /note="Description of Artificial Sequence: Synthetic oligonucleotide"
uggcccaugugugaucuugua

SEQ ID NO: 89 - RNA, 21 nt, Artificial Sequence
  source: /note="Description of Artificial Sequence: Synthetic oligonucleotide"
ccuaacuaaaauaauguuuaa

SEQ ID NO: 90 - RNA, 21 nt, Artificial Sequence
  source: /note="Description of Artificial Sequence: Synthetic oligonucleotide"
uuaccuguugaauuuuguauu

SEQ ID NO: 91 - RNA, 21 nt, Artificial Sequence
  source: /note="Description of Artificial Sequence: Synthetic oligonucleotide"
accuguugaauuuuguauuau

SEQ ID NO: 92 - RNA, 21 nt, Artificial Sequence
  source: /note="Description of Artificial Sequence: Synthetic oligonucleotide"
uguauuaugugaaucagugaa

SEQ ID NO: 93 - RNA, 21 nt, Artificial Sequence
  source: /note="Description of Artificial Sequence: Synthetic oligonucleotide"
uaugugaaucagugagauguu

SEQ ID NO: 94 - RNA, 21 nt, Artificial Sequence
  source: /note="Description of Artificial Sequence: Synthetic oligonucleotide"
gauguuaguagaauaagccuu

SEQ ID NO: 95 - RNA, 21 nt, Artificial Sequence
  source: /note="Description of Artificial Sequence: Synthetic oligonucleotide"
auguuaguagaauaagccuua

SEQ ID NO: 96 - RNA, 21 nt, Artificial Sequence
  source: /note="Description of Artificial Sequence: Synthetic oligonucleotide"
uggagcaacagugucuagaua

SEQ ID NO: 97 - RNA, 21 nt, Artificial Sequence
  source: /note="Description of Artificial Sequence: Synthetic oligonucleotide"
cuuuuggaggcagcuaggaaa

SEQ ID NO: 98 - RNA, 21 nt, Artificial Sequence
  source: /note="Description of Artificial Sequence: Synthetic oligonucleotide"
aagacaaugauuugguguuua

SEQ ID NO: 99 - RNA, 21 nt, Artificial Sequence
  source: /note="Description of Artificial Sequence: Synthetic oligonucleotide"
gacaaugauuugguguuuaga

SEQ ID NO: 100 - RNA, 21 nt, Artificial Sequence
  source: /note="Description of Artificial Sequence: Synthetic oligonucleotide"
caaugauuugguguuuagaaa

SEQ ID NO: 101 - RNA, 21 nt, Artificial Sequence
  source: /note="Description of Artificial Sequence: Synthetic oligonucleotide"
ugccagauaacuuauuacuuu

SEQ ID NO: 102 - RNA, 21 nt, Artificial Sequence
  source: /note="Description of Artificial Sequence: Synthetic oligonucleotide"
acaccuuuggcucuuacuaau

SEQ ID NO: 103 - RNA, 21 nt, Artificial Sequence
  source: /note="Description of Artificial Sequence: Synthetic oligonucleotide"
cuggcuccaaaucuuuguaua

SEQ ID NO: 104 - RNA, 21 nt, Artificial Sequence
  source: /note="Description of Artificial Sequence: Synthetic oligonucleotide"
uggcuccaaaucuuuguauaa

SEQ ID NO: 105 - RNA, 21 nt, Artificial Sequence
  source: /note="Description of Artificial Sequence: Synthetic oligonucleotide"
ccaaaucuuuguauagucaua

SEQ ID NO: 106 - RNA, 21 nt, Artificial Sequence
  source: /note="Description of Artificial Sequence: Synthetic oligonucleotide"
agagacaaagugucuaggcua

SEQ ID NO: 107 - RNA, 21 nt, Artificial Sequence
  source: /note="Description of Artificial Sequence: Synthetic oligonucleotide"
aagugucuaggcuacacagaa

SEQ ID NO: 108 - RNA, 21 nt, Artificial Sequence
  source: /note="Description of Artificial Sequence: Synthetic oligonucleotide"
agaaacuucugccuugcuuua

SEQ ID NO: 109 - RNA, 21 nt, Artificial Sequence
  source: /note="Description of Artificial Sequence: Synthetic oligonucleotide"
gaaggauugaauggauacaca

SEQ ID NO: 110 - RNA, 21 nt, Artificial Sequence
  source: /note="Description of Artificial Sequence: Synthetic oligonucleotide"
ggauugaauggauacaccaaa

SEQ ID NO: 111 - RNA, 23 nt, Artificial Sequence
  source: /note="Description of Artificial Sequence: Synthetic oligonucleotide"
uugguagaagcccaggaagccgc

SEQ ID NO: 112 - RNA, 23 nt, Artificial Sequence
  source: /note="Description of Artificial Sequence: Synthetic oligonucleotide"
uccaugaggaucuccauuauacg

SEQ ID NO: 113 - RNA, 23 nt, Artificial Sequence
  source: /note="Description of Artificial Sequence: Synthetic oligonucleotide"
uacuccuggccuuccgcacaaga

SEQ ID NO: 114 - RNA, 23 nt, Artificial Sequence
  source: /note="Description of Artificial Sequence: Synthetic oligonucleotide"
aauguuccgacuccuggccuucc

SEQ ID NO: 115 - RNA, 23 nt, Artificial Sequence
  source: /note="Description of Artificial Sequence: Synthetic oligonucleotide"
uaauguuccgacuccuggccuuc

SEQ ID NO: 116 - RNA, 23 nt, Artificial Sequence
  source: /note="Description of Artificial Sequence: Synthetic oligonucleotide"
uuuggaauggaacucagacacca

SEQ ID NO: 117 - RNA, 23 nt, Artificial Sequence
  source: /note="Description of Artificial Sequence: Synthetic oligonucleotide"
uacaccagggcauccacgacuuc

SEQ ID NO: 118 - RNA, 23 nt, Artificial Sequence
  source: /note="Description of Artificial Sequence: Synthetic oligonucleotide"
aaagucagacaccagaacguuuu

SEQ ID NO: 119 - RNA, 23 nt, Artificial Sequence
  source: /note="Description of Artificial Sequence: Synthetic oligonucleotide"
ugucuuuggaccgaaagucagac

SEQ ID NO: 120 - RNA, 23 nt, Artificial Sequence
  source: /note="Description of Artificial Sequence: Synthetic oligonucleotide"
acgacuucgucuuuggaccgaaa

SEQ ID NO: 121 - RNA, 23 nt, Artificial Sequence
  source: /note="Description of Artificial Sequence: Synthetic oligonucleotide"
uacgacuucgucuuuggaccgaa

SEQ ID NO: 122 - RNA, 23 nt, Artificial Sequence
  source: /note="Description of Artificial Sequence: Synthetic oligonucleotide"
uaaggcauccacgacuucgucuu

SEQ ID NO: 123 - RNA, 23 nt, Artificial Sequence
  source: /note="Description of Artificial Sequence: Synthetic oligonucleotide"
augaagcaggaacauaccaaggc

SEQ ID NO: 124 - RNA, 23 nt, Artificial Sequence
  source: /note="Description of Artificial Sequence: Synthetic oligonucleotide"
uaaggaaggagggauaaggccac

SEQ ID NO: 125 - RNA, 23 nt, Artificial Sequence
  source: /note="Description of Artificial Sequence: Synthetic oligonucleotide"
uguacguugucacucacuccucc

SEQ ID NO: 126 - RNA, 23 nt, Artificial Sequence
  source: /note="Description of Artificial Sequence: Synthetic oligonucleotide"
uaaggguacguugucacucacuc

SEQ ID NO: 127 - RNA, 23 nt, Artificial Sequence
  source: /note="Description of Artificial Sequence: Synthetic oligonucleotide"
uugaugguuguuuuggcaucaau

SEQ ID NO: 128 - RNA, 23 nt, Artificial Sequence
  source: /note="Description of Artificial Sequence: Synthetic oligonucleotide"
uugacuuuagggcagaugucgua

SEQ ID NO: 129 - RNA, 23 nt, Artificial Sequence
  source: /note="Description of Artificial Sequence: Synthetic oligonucleotide"
uuccagguacccuugauagcaca

SEQ ID NO: 130 - RNA, 23 nt, Artificial Sequence
  source: /note="Description of Artificial Sequence: Synthetic oligonucleotide"
uuccacaugaagaaaguucgugg

SEQ ID NO: 131 - RNA, 23 nt, Artificial Sequence
  source: /note="Description of Artificial Sequence: Synthetic oligonucleotide"
uaagguagagguucccugugcag

SEQ ID NO: 132 - RNA, 23 nt, Artificial Sequence
  source: /note="Description of Artificial Sequence: Synthetic oligonucleotide"
uaaggcauaucucucccagcacc

SEQ ID NO: 133 - RNA, 23 nt, Artificial Sequence
  source: /note="Description of Artificial Sequence: Synthetic oligonucleotide"
uucgaaggcauaucucucccagc

SEQ ID NO: 134 - RNA, 23 nt, Artificial Sequence
  source: /note="Description of Artificial Sequence: Synthetic oligonucleotide"
uauccucgaaggcauaucucucc

SEQ ID NO: 135 - RNA, 23 nt, Artificial Sequence
  source: /note="Description of Artificial Sequence: Synthetic oligonucleotide"
uaaauauccucgaaggcauaucu

SEQ ID NO: 136 - RNA, 23 nt, Artificial Sequence
  source: /note="Description of Artificial Sequence: Synthetic oligonucleotide"
auccaaauauccucgaaggcaua

SEQ ID NO: 137 - RNA, 23 nt, Artificial Sequence
  source: /note="Description of Artificial Sequence: Synthetic oligonucleotide"
uucucuuccaagaaccugaaugc

SEQ ID NO: 138 - RNA, 23 nt, Artificial Sequence
  source: /note="Description of Artificial Sequence: Synthetic oligonucleotide"
uauccaucccuucugaggaugac

SEQ ID NO: 139 - RNA, 23 nt, Artificial Sequence
  source: /note="Description of Artificial Sequence: Synthetic oligonucleotide"
augcucucaucccagggcaggau

SEQ ID NO: 140 - RNA, 23 nt, Artificial Sequence
  source: /note="Description of Artificial Sequence: Synthetic oligonucleotide"
uauucgggcacaaaccugggaug

SEQ ID NO: 141 - RNA, 23 nt, Artificial Sequence
  source: /note="Description of Artificial Sequence: Synthetic oligonucleotide"
uucauucgggcacaaaccuggga

SEQ ID NO: 142 - RNA, 23 nt, Artificial Sequence
  source: /note="Description of Artificial Sequence: Synthetic oligonucleotide"
ucucauguauccaccuuugucuu

SEQ ID NO: 143 - RNA, 23 nt, Artificial Sequence
  source: /note="Description of Artificial Sequence: Synthetic oligonucleotide"
uuugcucauguauccaccuuugu

SEQ ID NO: 144 - RNA, 23 nt, Artificial Sequence
  source: /note="Description of Artificial Sequence: Synthetic oligonucleotide"
aaaucuugcucauguauccaccu

SEQ ID NO: 145 - RNA, 23 nt, Artificial Sequence
  source: /note="Description of Artificial Sequence: Synthetic oligonucleotide"
uaaaucuugcucauguauccacc

SEQ ID NO: 146 - RNA, 23 nt, Artificial Sequence
  source: /note="Description of Artificial Sequence: Synthetic oligonucleotide"
uugcaaaucuugcucauguaucc

SEQ ID NO: 147 - RNA, 23 nt, Artificial Sequence
  source: /note="Description of Artificial Sequence: Synthetic oligonucleotide"
uagcaaguugcaaaucuugcuca

SEQ ID NO: 148 - RNA, 23 nt, Artificial Sequence
  source: /note="Description of Artificial Sequence: Synthetic oligonucleotide"
uguagcaaguugcaaaucuugcu

SEQ ID NO: 149 - RNA, 23 nt, Artificial Sequence
  source: /note="Description of Artificial Sequence: Synthetic oligonucleotide"
auggguagcaaguugcaaaucuu

SEQ ID NO: 150 - RNA, 23 nt, Artificial Sequence
  source: /note="Description of Artificial Sequence: Synthetic oligonucleotide"
ucuaauggguagcaaguugcaaa

SEQ ID NO: 151 - RNA, 23 nt, Artificial Sequence
  source: /note="Description of Artificial Sequence: Synthetic oligonucleotide"
uauccuaauggguagcaaguugc

SEQ ID NO: 152 - RNA, 23 nt, Artificial Sequence
  source: /note="Description of Artificial Sequence: Synthetic oligonucleotide"
ucucuggacaaucgcaauggcag

SEQ ID NO: 153 - RNA, 23 nt, Artificial Sequence
  source: /note="Description of Artificial Sequence: Synthetic oligonucleotide"
uucaccagucucuggacaaucgc

SEQ ID NO: 154 - RNA, 23 nt, Artificial Sequence
  source: /note="Description of Artificial Sequence: Synthetic oligonucleotide"
uaucuggaagccaugucaccagu

SEQ ID NO: 155 - RNA, 23 nt, Artificial Sequence
  source: /note="Description of Artificial Sequence: Synthetic oligonucleotide"
uacaucgucgggcauaucuggaa

SEQ ID NO: 156 - RNA, 23 nt, Artificial Sequence
  source: /note="Description of Artificial Sequence: Synthetic oligonucleotide"
uaggucacccacugcaaccacag

SEQ ID NO: 157 - RNA, 23 nt, Artificial Sequence
  source: /note="Description of Artificial Sequence: Synthetic oligonucleotide"
ucucacuggcauuugggaccugg

SEQ ID NO: 158 - RNA, 23 nt, Artificial Sequence
  source: /note="Description of Artificial Sequence: Synthetic oligonucleotide"
uagacucgccuccucaagugacu

SEQ ID NO: 159 - RNA, 23 nt, Artificial Sequence
  source: /note="Description of Artificial Sequence: Synthetic oligonucleotide"
ucugaaagaaucugcuagacucg

SEQ ID NO: 160 - RNA, 23 nt, Artificial Sequence
  source: /note="Description of Artificial Sequence: Synthetic oligonucleotide"
uuuuagcaccucugaaagaaucu

SEQ ID NO: 161 - RNA, 23 nt, Artificial Sequence
  source: /note="Description of Artificial Sequence: Synthetic oligonucleotide"
acuuuagcaccucugaaagaauc

SEQ ID NO: 162 - RNA, 23 nt, Artificial Sequence
  source: /note="Description of Artificial Sequence: Synthetic oligonucleotide"
aaagaugggaaacuuuagcaccu

SEQ ID NO: 163 - RNA, 23 nt, Artificial Sequence
  source: /note="Description of Artificial Sequence: Synthetic oligonucleotide"
uguagcugcacaaagaugggaaa

SEQ ID NO: 164 - RNA, 23 nt, Artificial Sequence
  source: /note="Description of Artificial Sequence: Synthetic oligonucleotide"
uauccuccacgucacaggcaggg

SEQ ID NO: 165 - RNA, 23 nt, Artificial Sequence
  source: /note="Description of Artificial Sequence: Synthetic oligonucleotide"
ucugggauccuccacgucacagg

SEQ ID NO: 166 - RNA, 23 nt, Artificial Sequence
  source: /note="Description of Artificial Sequence: Synthetic oligonucleotide"
auaaaaccaacucagcucagagg

SEQ ID NO: 167 - RNA, 23 nt, Artificial Sequence
  source: /note="Description of Artificial Sequence: Synthetic oligonucleotide"
uauaaaaccaacucagcucagag

SEQ ID NO: 168 - RNA, 23 nt, Artificial Sequence
  source: /note="Description of Artificial Sequence: Synthetic oligonucleotide"
uagcuuuucauaaaaccaacuca

SEQ ID NO: 169 - RNA, 23 nt, Artificial Sequence
  source: /note="Description of Artificial Sequence: Synthetic oligonucleotide"
ucuagcuuuucauaaaaccaacu

SEQ ID NO: 170 - RNA, 23 nt, Artificial Sequence
  source: /note="Description of Artificial Sequence: Synthetic oligonucleotide"
uuccuagcuuuucauaaaaccaa

SEQ ID NO: 171 - RNA, 23 nt, Artificial Sequence
  source: /note="Description of Artificial Sequence: Synthetic oligonucleotide"
uuuccuagcuuuucauaaaacca

SEQ ID NO: 172 - RNA, 23 nt, Artificial Sequence
  source: /note="Description of Artificial Sequence: Synthetic oligonucleotide"
ucuuccuagcuuuucauaaaacc

SEQ ID NO: 173 - RNA, 23 nt, Artificial Sequence
  source: /note="Description of Artificial Sequence: Synthetic oligonucleotide"
uuugcuuccuagcuuuucauaaa

SEQ ID NO: 174 - RNA, 23 nt, Artificial Sequence
  source: /note="Description of Artificial Sequence: Synthetic oligonucleotide"
ucccaaccagcugaauuaacgca

SEQ ID NO: 175 - RNA, 23 nt, Artificial Sequence
  source: /note="Description of Artificial Sequence: Synthetic oligonucleotide"
uucccaaccagcugaauuaacgc

SEQ ID NO: 176 - RNA, 23 nt, Artificial Sequence
  source: /note="Description of Artificial Sequence: Synthetic oligonucleotide"
ugugucauuucccaaccagcuga

SEQ ID NO: 177 - RNA, 23 nt, Artificial Sequence
  source: /note="Description of Artificial Sequence: Synthetic oligonucleotide"
aacagucugaccauuaauagggc

SEQ ID NO: 178 - RNA, 23 nt, Artificial Sequence
  source: /note="Description of Artificial Sequence: Synthetic oligonucleotide"
uaacagucugaccauuaauaggg

SEQ ID NO: 179 - RNA, 23 nt, Artificial Sequence
  source: /note="Description of Artificial Sequence: Synthetic oligonucleotide"
uaagaucacacaugggccagccu

SEQ ID NO: 180 - RNA, 23 nt, Artificial Sequence
  source: /note="Description of Artificial Sequence: Synthetic oligonucleotide"
uacaagaucacacaugggccagc

SEQ ID NO: 181 - RNA, 23 nt, Artificial Sequence
  source: /note="Description of Artificial Sequence: Synthetic oligonucleotide"
uuaaacauuauuuuaguuaggug

SEQ ID NO: 182 - RNA, 23 nt, Artificial Sequence
  source: /note="Description of Artificial Sequence: Synthetic oligonucleotide"
aauacaaaauucaacagguaaca

SEQ ID NO: 183 - RNA, 23 nt, Artificial Sequence
  source: /note="Description of Artificial Sequence: Synthetic oligonucleotide"
auaauacaaaauucaacagguaa

SEQ ID NO: 184 - RNA, 23 nt, Artificial Sequence
  source: /note="Description of Artificial Sequence: Synthetic oligonucleotide"
uucacugauucacauaauacaaa

SEQ ID NO: 185 - RNA, 23 nt, Artificial Sequence
  source: /note="Description of Artificial Sequence: Synthetic oligonucleotide"
aacaucucacugauucacauaau

SEQ ID NO: 186 - RNA, 23 nt, Artificial Sequence
  source: /note="Description of Artificial Sequence: Synthetic oligonucleotide"
aaggcuuauucuacuaacaucuc

SEQ ID NO: 187 - RNA, 23 nt, Artificial Sequence
  source: /note="Description of Artificial Sequence: Synthetic oligonucleotide"
uaaggcuuauucuacuaacaucu

SEQ ID NO: 188 - RNA, 23 nt, Artificial Sequence
  source: /note="Description of Artificial Sequence: Synthetic oligonucleotide"
uaucuagacacuguugcuccaga

SEQ ID NO: 189 - RNA, 23 nt, Artificial Sequence
  source: /note="Description of Artificial Sequence: Synthetic oligonucleotide"
uuuccuagcugccuccaaaagua

SEQ ID NO: 190 - RNA, 23 nt, Artificial Sequence
  source: /note="Description of Artificial Sequence: Synthetic oligonucleotide"
uaaacaccaaaucauugucuuug

SEQ ID NO: 191 - RNA, 23 nt, Artificial Sequence
  source: /note="Description of Artificial Sequence: Synthetic oligonucleotide"
ucuaaacaccaaaucauugucuu

SEQ ID NO: 192 - RNA, 23 nt, Artificial Sequence
  source: /note="Description of Artificial Sequence: Synthetic oligonucleotide"
uuucuaaacaccaaaucauuguc

SEQ ID NO: 193 - RNA, 23 nt, Artificial Sequence
  source: /note="Description of Artificial Sequence: Synthetic oligonucleotide"
aaaguaauaaguuaucuggcagg

SEQ ID NO: 194 - RNA, 23 nt, Artificial Sequence
  source: /note="Description of Artificial Sequence: Synthetic oligonucleotide"
auuaguaagagccaaaggugucc

SEQ ID NO: 195 - RNA, 23 nt, Artificial Sequence
  source: /note="Description of Artificial Sequence: Synthetic oligonucleotide"
uauacaaagauuuggagccagug

SEQ ID NO: 196 - RNA, 23 nt, Artificial Sequence
  source: /note="Description of Artificial Sequence: Synthetic oligonucleotide"
uuauacaaagauuuggagccagu

SEQ ID NO: 197 - RNA, 23 nt, Artificial Sequence
  source: /note="Description of Artificial Sequence: Synthetic oligonucleotide"
uaugacuauacaaagauuuggag

SEQ ID NO: 198 - RNA, 23 nt, Artificial Sequence
  source: /note="Description of Artificial Sequence: Synthetic oligonucleotide"
uagccuagacacuuugucucuag

SEQ ID NO: 199 - RNA, 23 nt, Artificial Sequence
  source: /note="Description of Artificial Sequence: Synthetic oligonucleotide"
uucuguguagccuagacacuuug

SEQ ID NO: 200 - RNA, 23 nt, Artificial Sequence
  source: /note="Description of Artificial Sequence: Synthetic oligonucleotide"
uaaagcaaggcagaaguuucuac

SEQ ID NO: 201 - RNA, 23 nt, Artificial Sequence
  source: /note="Description of Artificial Sequence: Synthetic oligonucleotide"
uguguauccauucaauccuucug

SEQ ID NO: 202 - RNA, 23 nt, Artificial Sequence
  source: /note="Description of Artificial Sequence: Synthetic oligonucleotide"
uuugguguauccauucaauccuu

SEQ ID NO: 203 - RNA, 19 nt, Artificial Sequence
  source: /note="Description of Artificial Sequence: Synthetic oligonucleotide"
gggggcggggcugacguca

SEQ ID NO: 204 - RNA, 19 nt, Artificial Sequence
  source: /note="Description of Artificial Sequence: Synthetic oligonucleotide"
acgucgcgcugggaaugca

SEQ ID NO: 205 - RNA, 19 nt, Artificial Sequence
  source: /note="Description of Artificial Sequence: Synthetic oligonucleotide"
ggaaugcccuggccgagaa

SEQ ID NO: 206 - RNA, 19 nt, Artificial Sequence
  source: /note="Description of Artificial Sequence: Synthetic oligonucleotide"
uggccgagacacugaggca

SEQ ID NO: 207 - RNA, 19 nt, Artificial Sequence
  source: /note="Description of Artificial Sequence: Synthetic oligonucleotide"
ugaggcaggguagagagca

SEQ ID NO: 208 - RNA, 19 nt, Artificial Sequence
  source: /note="Description of Artificial Sequence: Synthetic oligonucleotide"
agagagcgcuugcgggcga

SEQ ID NO: 209 - RNA, 19 nt, Artificial Sequence
  source: /note="Description of Artificial Sequence: Synthetic oligonucleotide"
cgggcgccgggcggagcua

SEQ ID NO: 210 - RNA, 19 nt, Artificial Sequence
  source: /note="Description of Artificial Sequence: Synthetic oligonucleotide"
gcggagcugcugcggauca

SEQ ID NO: 211 - RNA, 19 nt, Artificial Sequence
  source: /note="Description of Artificial Sequence: Synthetic oligonucleotide"
ugcggaucaggacccgaga

SEQ ID NO: 212 - RNA, 19 nt, Artificial Sequence
  source: /note="Description of Artificial Sequence: Synthetic oligonucleotide"
acccgagccgauucccgau

SEQ ID NO: 213 - RNA, 19 nt, Artificial Sequence
  source: /note="Description of Artificial Sequence: Synthetic oligonucleotide"
uucccgaucccgacccaga

SEQ ID NO: 214 - RNA, 19 nt, Artificial Sequence
  source: /note="Description of Artificial Sequence: Synthetic oligonucleotide"
acccagauccuaacccgca

SEQ ID NO: 215 - RNA, 19 nt, Artificial Sequence
  source: /note="Description of Artificial Sequence: Synthetic oligonucleotide"
uaacccgcgcccccgccca

SEQ ID NO: 216 - RNA, 19 nt, Artificial Sequence
  source: /note="Description of Artificial Sequence: Synthetic oligonucleotide"
ccgccccgccgccgccgca

SEQ ID NO: 217 - RNA, 19 nt, Artificial Sequence
  source: /note="Description of Artificial Sequence: Synthetic oligonucleotide"
cgccgccauguacgacgca

SEQ ID NO: 218 - RNA, 19 nt, Artificial Sequence
  source: /note="Description of Artificial Sequence: Synthetic oligonucleotide"
uacgacgcagagcgcggcu

SEQ ID NO: 219 - RNA, 19 nt, Artificial Sequence
  source: /note="Description of Artificial Sequence: Synthetic oligonucleotide"
cgcggcuggagcuuguccu

SEQ ID NO: 220 - RNA, 19 nt, Artificial Sequence
  source: /note="Description of Artificial Sequence: Synthetic oligonucleotide"
agcuuguccuucgcgggcu

SEQ ID NO: 221 - RNA, 19 nt, Artificial Sequence
  source: /note="Description of Artificial Sequence: Synthetic oligonucleotide"
cgcgggcugcggcuuccua

SEQ ID NO: 222 - RNA, 19 nt, Artificial Sequence
  source: /note="Description of Artificial Sequence: Synthetic oligonucleotide"
uuccugggcuucuaccaca

SEQ ID NO: 223 - RNA, 19 nt, Artificial Sequence
  source: /note="Description of Artificial Sequence: Synthetic oligonucleotide"
uucuaccacgucggggcga

SEQ ID NO: 224 - RNA, 19 nt, Artificial Sequence
  source: /note="Description of Artificial Sequence: Synthetic oligonucleotide"
cggggcgacccgcugccua

SEQ ID NO: 225 - RNA, 19 nt, Artificial Sequence
  source: /note="Description of Artificial Sequence: Synthetic oligonucleotide"
ugccugagcgagcacgcca

SEQ ID NO: 226 - RNA, 19 nt, Artificial Sequence
  source: /note="Description of Artificial Sequence: Synthetic oligonucleotide"
agcacgccccgcaccuccu

SEQ ID NO: 227 - RNA, 19 nt, Artificial Sequence
  source: /note="Description of Artificial Sequence: Synthetic oligonucleotide"
accuccuccgcgacgcgca

SEQ ID NO: 228 - RNA, 19 nt, Artificial Sequence
  source: /note="Description of Artificial Sequence: Synthetic oligonucleotide"
gcgacgcgcgcauguuguu

SEQ ID NO: 229 - RNA, 19 nt, Artificial Sequence
  source: /note="Description of Artificial Sequence: Synthetic oligonucleotide"
uguuguucggcgcuucgga

SEQ ID NO: 230 - RNA, 19 nt, Artificial Sequence
  source: /note="Description of Artificial Sequence: Synthetic oligonucleotide"
cuucggccggggcguugca

SEQ ID NO: 231 - RNA, 19 nt, Artificial Sequence
  source: /note="Description of Artificial Sequence: Synthetic oligonucleotide"
ggcguugcacugcgucgga

SEQ ID NO: 232 - RNA, 19 nt, Artificial Sequence
  source: /note="Description of Artificial Sequence: Synthetic oligonucleotide"
ugcgucggcguccucucca

SEQ ID NO: 233 - RNA, 19 nt, Artificial Sequence
  source: /note="Description of Artificial Sequence: Synthetic oligonucleotide"
ucuccgguaucccgcugga

SEQ ID NO: 234 - RNA, 19 nt, Artificial Sequence
  source: /note="Description of Artificial Sequence: Synthetic oligonucleotide"
ucccgcuggagcagacucu

SEQ ID NO: 235 - RNA, 19 nt, Artificial Sequence
  source: /note="Description of Artificial Sequence: Synthetic oligonucleotide"
cagacucugcagguccucu

SEQ ID NO: 236 - RNA, 19 nt, Artificial Sequence
  source: /note="Description of Artificial Sequence: Synthetic oligonucleotide"
uccucucagaucuugugca

SEQ ID NO: 237 - RNA, 19 nt, Artificial Sequence
  source: /note="Description of Artificial Sequence: Synthetic oligonucleotide"
ucuugugcggaaggccaga

SEQ ID NO: 238 - RNA, 19 nt, Artificial Sequence
  source: /note="Description of Artificial Sequence: Synthetic oligonucleotide"
aaggccaggagucggaaca

SEQ ID NO: 239 - RNA, 19 nt, Artificial Sequence
  source: /note="Description of Artificial Sequence: Synthetic oligonucleotide"
cggaacauuggcaucuuca

SEQ ID NO: 240 - RNA, 19 nt, Artificial Sequence
  source: /note="Description of Artificial Sequence: Synthetic oligonucleotide"
gcaucuuccauccauccuu

SEQ ID NO: 241 - RNA, 19 nt, Artificial Sequence
  source: /note="Description of Artificial Sequence: Synthetic oligonucleotide"
ccauccuucaacuuaagca

SEQ ID NO: 242 - RNA, 19 nt, Artificial Sequence
  source: /note="Description of Artificial Sequence: Synthetic oligonucleotide"
uuaagcaaguuccuccgaa

SEQ ID NO: 243 - RNA, 19 nt, Artificial Sequence
  source: /note="Description of Artificial Sequence: Synthetic oligonucleotide"
ccuccgacagggucucuga

SEQ ID NO: 244 - RNA, 19 nt, Artificial Sequence
  source: /note="Description of Artificial Sequence: Synthetic oligonucleotide"
ucucugcaaaugccuccca

SEQ ID NO: 245 - RNA, 19 nt, Artificial Sequence
  source: /note="Description of Artificial Sequence: Synthetic oligonucleotide"
ugccucccggccaauguca

SEQ ID NO: 246 - RNA, 19 nt, Artificial Sequence
  source: /note="Description of Artificial Sequence: Synthetic oligonucleotide"
aauguccaccagcucaucu

SEQ ID NO: 247 - RNA, 19 nt, Artificial Sequence
  source: /note="Description of Artificial Sequence: Synthetic oligonucleotide"
agcucaucuccggcaaaau

SEQ ID NO: 248 - RNA, 19 nt, Artificial Sequence
  source: /note="Description of Artificial Sequence: Synthetic oligonucleotide"
cggcaaaauaggcaucucu

SEQ ID NO: 249 - RNA, 19 nt, Artificial Sequence
  source: /note="Description of Artificial Sequence: Synthetic oligonucleotide"
aucucucuuaccagagugu

SEQ ID NO: 250 - RNA, 19 nt, Artificial Sequence
  source: /note="Description of Artificial Sequence: Synthetic oligonucleotide"
accagagugucugauggga

SEQ ID NO: 251 - RNA, 19 nt, Artificial Sequence
  source: /note="Description of Artificial Sequence: Synthetic oligonucleotide"
auggggaaaacguucuggu

SEQ ID NO: 252 - RNA, 19 nt, Artificial Sequence
  source: /note="Description of Artificial Sequence: Synthetic oligonucleotide"
acguucuggugucugacuu

SEQ ID NO: 253 - RNA, 19 nt, Artificial Sequence
  source: /note="Description of Artificial Sequence: Synthetic oligonucleotide"
ucugacuuucgguccaaag

SEQ ID NO: 254 - RNA, 19 nt, Artificial Sequence
  source: /note="Description of Artificial Sequence: Synthetic oligonucleotide"
uccaaagacgaagucguga

SEQ ID NO: 255 - RNA, 19 nt, Artificial Sequence
  source: /note="Description of Artificial Sequence: Synthetic oligonucleotide"
aagucguggaugccuuggu

SEQ ID NO: 256 - RNA, 19 nt, Artificial Sequence
  source: /note="Description of Artificial Sequence: Synthetic oligonucleotide"
ccuugguauguuccugcuu

SEQ ID NO: 257 - RNA, 19 nt, Artificial Sequence
  source: /note="Description of Artificial Sequence: Synthetic oligonucleotide"
uccugcuucauccccuucu

SEQ ID NO: 258 - RNA, 19 nt, Artificial Sequence
  source: /note="Description of Artificial Sequence: Synthetic oligonucleotide"
uccccuucuacaguggccu

SEQ ID NO: 259 - RNA, 19 nt, Artificial Sequence
  source: /note="Description of Artificial Sequence: Synthetic oligonucleotide"
aguggccuuaucccuccuu

SEQ ID NO: 260 - RNA, 19 nt, Artificial Sequence
  source: /note="Description of Artificial Sequence: Synthetic oligonucleotide"
ccuccuuccuucagaggca

SEQ ID NO: 261 - RNA, 19 nt, Artificial Sequence
  source: /note="Description of Artificial Sequence: Synthetic oligonucleotide"
ucagaggcgugcgauaugu

SEQ ID NO: 262 - RNA, 19 nt, Artificial Sequence
  source: /note="Description of Artificial Sequence: Synthetic oligonucleotide"
gauauguggauggaggagu

SEQ ID NO: 263 - RNA, 19 nt, Artificial Sequence
  source: /note="Description of Artificial Sequence: Synthetic oligonucleotide"
gaggagugagugacaacgu

SEQ ID NO: 264 - RNA, 19 nt, Artificial Sequence
  source: /note="Description of Artificial Sequence: Synthetic oligonucleotide"
ugacaacguacccuucauu

SEQ ID NO: 265 - RNA, 19 nt, Artificial Sequence
  source: /note="Description of Artificial Sequence: Synthetic oligonucleotide"
ccuucauugaugccaaaac

SEQ ID NO: 266 - RNA, 19 nt, Artificial Sequence
  source: /note="Description of Artificial Sequence: Synthetic oligonucleotide"
ugccaaaacaaccaucaca

SEQ ID NO: 267 - RNA, 19 nt, Artificial Sequence
  source: /note="Description of Artificial Sequence: Synthetic oligonucleotide"
aucaccgugucccccuucu

SEQ ID NO: 268 - RNA, 19 nt, Artificial Sequence
  source: /note="Description of Artificial Sequence: Synthetic oligonucleotide"
ucccccuucuauggggagu

SEQ ID NO: 269 - RNA, 19 nt, Artificial Sequence
  source: /note="Description of Artificial Sequence: Synthetic oligonucleotide"
uggggaguacgacaucuga

SEQ ID NO: 270 - RNA, 19 nt, Artificial Sequence
  source: /note="Description of Artificial Sequence: Synthetic oligonucleotide"
aucugcccuaaagucaagu

SEQ ID NO: 271 - RNA, 19 nt, Artificial Sequence
  source: /note="Description of Artificial Sequence: Synthetic oligonucleotide"
agucaaguccacgaacuuu

SEQ ID NO: 272 - RNA, 19 nt, Artificial Sequence
  source: /note="Description of Artificial Sequence: Synthetic oligonucleotide"
acgaacuuucuucauguga

SEQ ID NO: 273 - RNA, 19 nt, Artificial Sequence
  source: /note="Description of Artificial Sequence: Synthetic oligonucleotide"
uucauguggacaucaccaa

SEQ ID NO: 274 - RNA, 19 nt, Artificial Sequence
  source: /note="Description of Artificial Sequence: Synthetic oligonucleotide"
ucaccaagcucagucuaca

SEQ ID NO: 275 - RNA, 19 nt, Artificial Sequence
  source: /note="Description of Artificial Sequence: Synthetic oligonucleotide"
agucuacgccucugcacaa

SEQ ID NO: 276 - RNA, 19 nt, Artificial Sequence
  source: /note="Description of Artificial Sequence: Synthetic oligonucleotide"
cugcacagggaaccucuaa

SEQ ID NO: 277 - RNA, 19 nt, Artificial Sequence
  source: /note="Description of Artificial Sequence: Synthetic oligonucleotide"
aaccucuaccuucucucga

SEQ ID NO: 278 - RNA, 19 nt, Artificial Sequence
  source: /note="Description of Artificial Sequence: Synthetic oligonucleotide"
ucucgagagcuuuugucca

SEQ ID NO: 279 - RNA, 19 nt, Artificial Sequence
  source: /note="Description of Artificial Sequence: Synthetic oligonucleotide"
uuuguccccccggaucuca

SEQ ID NO: 280 - RNA, 19 nt, Artificial Sequence
  source: /note="Description of Artificial Sequence: Synthetic oligonucleotide"
ccggaucucaaggugcuga

SEQ ID NO: 281 - RNA, 19 nt, Artificial Sequence
  source: /note="Description of Artificial Sequence: Synthetic oligonucleotide"
ugcugggagagauaugccu

SEQ ID NO: 282 - RNA, 19 nt, Artificial Sequence
  source: /note="Description of Artificial Sequence: Synthetic oligonucleotide"
agauaugccuucgaggaua

SEQ ID NO: 283 - RNA, 19 nt, Artificial Sequence
  source: /note="Description of Artificial Sequence: Synthetic oligonucleotide"
aggauauuuggaugcauua

SEQ ID NO: 284 - RNA, 19 nt, Artificial Sequence
  source: /note="Description of Artificial Sequence: Synthetic oligonucleotide"
augcauucagguucuugga

SEQ ID NO: 285 - RNA, 19 nt, Artificial Sequence
  source: /note="Description of Artificial Sequence: Synthetic oligonucleotide"
uucuuggaagagaagggca

SEQ ID NO: 286 - RNA, 19 nt, Artificial Sequence
  source: /note="Description of Artificial Sequence: Synthetic oligonucleotide"
gagaagggcaucugcaaca

SEQ ID NO: 287 - RNA, 19 nt, Artificial Sequence
  source: /note="Description of Artificial Sequence: Synthetic oligonucleotide"
ugcaacaggccccagccaa

SEQ ID NO: 288 - RNA, 19 nt, Artificial Sequence
  source: /note="Description of Artificial Sequence: Synthetic oligonucleotide"
cagccaggccugaagucau

SEQ ID NO: 289 - RNA, 19 nt, Artificial Sequence
  source: /note="Description of Artificial Sequence: Synthetic oligonucleotide"
gaagucauccucagaagga

SEQ ID NO: 290 - RNA, 19 nt, Artificial Sequence
  source: /note="Description of Artificial Sequence: Synthetic oligonucleotide"
ucagaagggauggauccua

SEQ ID NO: 291 - RNA, 19 nt, Artificial Sequence
  source: /note="Description of Artificial Sequence: Synthetic oligonucleotide"
uggauccugaggucgccau

SEQ ID NO: 292 - RNA, 19 nt, Artificial Sequence
  source: /note="Description of Artificial Sequence: Synthetic oligonucleotide"
cgccaugcccagcugggca

SEQ ID NO: 293 - RNA, 19 nt, Artificial Sequence
  source: /note="Description of Artificial Sequence: Synthetic oligonucleotide"
cagcugggcaaacaugagu

SEQ ID NO: 294 - RNA, 19 nt, Artificial Sequence
  source: /note="Description of Artificial Sequence: Synthetic oligonucleotide"
caugagucuggauucuuca

SEQ ID NO: 295 - RNA, 19 nt, Artificial Sequence
  source: /note="Description of Artificial Sequence: Synthetic oligonucleotide"
uucuuccccggagucggcu

SEQ ID NO: 296 - RNA, 19 nt, Artificial Sequence
  source: /note="Description of Artificial Sequence: Synthetic oligonucleotide"
agucggcugccuuggcugu

SEQ ID NO: 297 - RNA, 19 nt, Artificial Sequence
  source: /note="Description of Artificial Sequence: Synthetic oligonucleotide"
uuggcugugaggcuggaga

SEQ ID NO: 298 - RNA, 19 nt, Artificial Sequence
  source: /note="Description of Artificial Sequence: Synthetic oligonucleotide"
aggcuggagggagaugaga

SEQ ID NO: 299 - RNA, 19 nt, Artificial Sequence
  source: /note="Description of Artificial Sequence: Synthetic oligonucleotide"
augagcugcuagaccaccu

SEQ ID NO: 300 - RNA, 19 nt, Artificial Sequence
  source: /note="Description of Artificial Sequence: Synthetic oligonucleotide"
uagaccaccugcgucucaa

SEQ ID NO: 301 - RNA, 19 nt, Artificial Sequence
  source: /note="Description of Artificial Sequence: Synthetic oligonucleotide"
cgucucagcauccugcccu

SEQ ID NO: 302 - RNA, 19 nt, Artificial Sequence
  source: /note="Description of Artificial Sequence: Synthetic oligonucleotide"
ccugcccugggaugagaga

SEQ ID NO: 303 - RNA, 19 nt, Artificial Sequence
  source: /note="Description of Artificial Sequence: Synthetic oligonucleotide"
augagagcauccuggacaa

SEQ ID NO: 304 - RNA, 19 nt, Artificial Sequence
  source: /note="Description of Artificial Sequence: Synthetic oligonucleotide"
uggacacccucucgcccaa

SEQ ID NO: 305 - RNA, 19 nt, Artificial Sequence
  source: /note="Description of Artificial Sequence: Synthetic oligonucleotide"
ucgcccaggcucgcuacaa

SEQ ID NO: 306 - RNA, 19 nt, Artificial Sequence
  source: /note="Description of Artificial Sequence: Synthetic oligonucleotide"
ucgcuacagcacugaguga

SEQ ID NO: 307 - RNA, 19 nt, Artificial Sequence
  source: /note="Description of Artificial Sequence: Synthetic oligonucleotide"
cugagugaagaaaugaaag

SEQ ID NO: 308 - RNA, 19 nt, Artificial Sequence
  source: /note="Description of Artificial Sequence: Synthetic oligonucleotide"
augaaagacaaagguggau

SEQ ID NO: 309 - RNA, 19 nt, Artificial Sequence
  source: /note="Description of Artificial Sequence: Synthetic oligonucleotide"
aagguggauacaugagcaa

SEQ ID NO: 310 - RNA, 19 nt, Artificial Sequence
  source: /note="Description of Artificial Sequence: Synthetic oligonucleotide"
augagcaagauuugcaacu

SEQ ID NO: 311 - RNA, 19 nt, Artificial Sequence
  source: /note="Description of Artificial Sequence: Synthetic oligonucleotide"
uugcaacuugcuacccauu

SEQ ID NO: 312 - RNA, 19 nt, Artificial Sequence
  source: /note="Description of Artificial Sequence: Synthetic oligonucleotide"
acccauuaggauaaugucu

SEQ ID NO: 313 - RNA, 19 nt, Artificial Sequence
  source: /note="Description of Artificial Sequence: Synthetic oligonucleotide"
uaaugucuuauguaaugcu

SEQ ID NO: 314 - RNA, 19 nt, Artificial Sequence
  source: /note="Description of Artificial Sequence: Synthetic oligonucleotide"
uaaugcugcccuguacccu

SEQ ID NO: 315 - RNA, 19 nt, Artificial Sequence
  source: /note="Description of Artificial Sequence: Synthetic oligonucleotide"
uguacccugccuguggaau

SEQ ID NO: 316 - RNA, 19 nt, Artificial Sequence
  source: /note="Description of Artificial Sequence: Synthetic oligonucleotide"
uguggaaucugccauugca

SEQ ID NO: 317 - RNA, 19 nt, Artificial Sequence
  source: /note="Description of Artificial Sequence: Synthetic oligonucleotide"
ugccauugcgauuguccaa

SEQ ID NO: 318 - RNA, 19 nt, Artificial Sequence
  source: /note="Description of Artificial Sequence: Synthetic oligonucleotide"
uuguccagagacuggugaa

SEQ ID NO: 319 - RNA, 19 nt, Artificial Sequence
  source: /note="Description of Artificial Sequence: Synthetic oligonucleotide"
ggugacauggcuuccagau

SEQ ID NO: 320 - RNA, 19 nt, Artificial Sequence
  source: /note="Description of Artificial Sequence: Synthetic oligonucleotide"
uuccagauaugcccgacga

SEQ ID NO: 321 - RNA, 19 nt, Artificial Sequence
  source: /note="Description of Artificial Sequence: Synthetic oligonucleotide"
ugcccgacgauguccugua

SEQ ID NO: 322 - RNA, 19 nt, Artificial Sequence
  source: /note="Description of Artificial Sequence: Synthetic oligonucleotide"
uccugugguugcagugggu

SEQ ID NO: 323 - RNA, 19 nt, Artificial Sequence
  source: /note="Description of Artificial Sequence: Synthetic oligonucleotide"
agugggugaccucacaggu

SEQ ID NO: 324 - RNA, 19 nt, Artificial Sequence
  source: /note="Description of Artificial Sequence: Synthetic oligonucleotide"
ucacagguguucacucgaa

SEQ ID NO: 325 - RNA, 19 nt, Artificial Sequence
  source: /note="Description of Artificial Sequence: Synthetic oligonucleotide"
uucacucgagugcugaugu

SEQ ID NO: 326 - RNA, 19 nt, Artificial Sequence
  source: /note="Description of Artificial Sequence: Synthetic oligonucleotide"
ugaugugucugcuccccga

SEQ ID NO: 327 - RNA, 19 nt, Artificial Sequence
  source: /note="Description of Artificial Sequence: Synthetic oligonucleotide"
ugcuccccgccuccaggua

SEQ ID NO: 328 - RNA, 19 nt, Artificial Sequence
  source: /note="Description of Artificial Sequence: Synthetic oligonucleotide"
ccaggucccaaaugccagu

SEQ ID NO: 329 - RNA, 19 nt, Artificial Sequence
  source: /note="Description of Artificial Sequence: Synthetic oligonucleotide"
aaugccagugagcagccaa

SEQ ID NO: 330 - RNA, 19 nt, Artificial Sequence
  source: /note="Description of Artificial Sequence: Synthetic oligonucleotide"
agccaacaggccuccccau

SEQ ID NO: 331 - RNA, 19 nt, Artificial Sequence
  source: /note="Description of Artificial Sequence: Synthetic oligonucleotide"
ccuccccaugcacaccuga

SEQ ID NO: 332 - RNA, 19 nt, Artificial Sequence
  source: /note="Description of Artificial Sequence: Synthetic oligonucleotide"
caccugagcaggacuggca

SEQ ID NO: 333 - RNA, 19 nt, Artificial Sequence
  source: /note="Description of Artificial Sequence: Synthetic oligonucleotide"
gacuggcccugcuggacua

SEQ ID NO: 334 - RNA, 19 nt, Artificial Sequence
  source: /note="Description of Artificial Sequence: Synthetic oligonucleotide"
ugcuggacucccugcucca

SEQ ID NO: 335 - RNA, 19 nt, Artificial Sequence
  source: /note="Description of Artificial Sequence: Synthetic oligonucleotide"
cugcucccccaagggcugu

SEQ ID NO: 336 - RNA, 19 nt, Artificial Sequence
  source: /note="Description of Artificial Sequence: Synthetic oligonucleotide"
agggcuguccagcagagaa

SEQ ID NO: 337 - RNA, 19 nt, Artificial Sequence
  source: /note="Description of Artificial Sequence: Synthetic oligonucleotide"
cagagaccaaagcagagga

SEQ ID NO: 338 - RNA, 19 nt, Artificial Sequence
  source: /note="Description of Artificial Sequence: Synthetic oligonucleotide"
agcagaggccaccccgcga

SEQ ID NO: 339 - RNA, 19 nt, Artificial Sequence
  source: /note="Description of Artificial Sequence: Synthetic oligonucleotide"
ccgcgguccauccucaggu

SEQ ID NO: 340 - RNA, 19 nt, Artificial Sequence
  source: /note="Description of Artificial Sequence: Synthetic oligonucleotide"
ccucagguccagccugaaa

SEQ ID NO: 341 - RNA, 19 nt, Artificial Sequence
  source: /note="Description of Artificial Sequence: Synthetic oligonucleotide"
agccugaacuucuucuuga

SEQ ID NO: 342 - RNA, 19 nt, Artificial Sequence
  source: /note="Description of Artificial Sequence: Synthetic oligonucleotide"
uucuugggcaauaaaguaa

SEQ ID NO: 343 - RNA, 19 nt, Artificial Sequence
  source: /note="Description of Artificial Sequence: Synthetic oligonucleotide"
uaaaguaccugcuggugcu

SEQ ID NO: 344 - RNA, 19 nt, Artificial Sequence
  source: /note="Description of Artificial Sequence: Synthetic oligonucleotide"
cuggugcugaggggcucua

SEQ ID NO: 345 - RNA, 19 nt, Artificial Sequence
  source: /note="Description of Artificial Sequence: Synthetic oligonucleotide"
aggggcucuccaccuuuca

SEQ ID NO: 346 - RNA, 19 nt, Artificial Sequence
  source: /note="Description of Artificial Sequence: Synthetic oligonucleotide"
ccuuucccaguuuuucacu

SEQ ID NO: 347 - RNA, 19 nt, Artificial Sequence
  source: /note="Description of Artificial Sequence: Synthetic oligonucleotide"
uuuuucacuagagaagagu

SEQ ID NO: 348 - RNA, 19 nt, Artificial Sequence
  source: /note="Description of Artificial Sequence: Synthetic oligonucleotide"
aagagucugugagucacuu

SEQ ID NO: 349 - RNA, 19 nt, Artificial Sequence
  source: /note="Description of Artificial Sequence: Synthetic oligonucleotide"
agucacuugaggaggcgaa

SEQ ID NO: 350 - RNA, 19 nt, Artificial Sequence
  source: /note="Description of Artificial Sequence: Synthetic oligonucleotide"
aggaggcgagucuagcaga

SEQ ID NO: 351 - RNA, 19 nt, Artificial Sequence
  source: /note="Description of Artificial Sequence: Synthetic oligonucleotide"
agcagauucuuucagaggu

SEQ ID NO: 352 - RNA, 19 nt, Artificial Sequence
  source: /note="Description of Artificial Sequence: Synthetic oligonucleotide"
uucagaggugcuaaaguuu

SEQ ID NO: 353 - RNA, 19 nt, Artificial Sequence
  source: /note="Description of Artificial Sequence: Synthetic oligonucleotide"
uaaaguuucccaucuuugu

SEQ ID NO: 354 - RNA, 19 nt, Artificial Sequence
  source: /note="Description of Artificial Sequence: Synthetic oligonucleotide"
ucuuugugcagcuaccuca

SEQ ID NO: 355 - RNA, 19 nt, Artificial Sequence
  source: /note="Description of Artificial Sequence: Synthetic oligonucleotide"
agcuaccuccgcauugcua

SEQ ID NO: 356 - RNA, 19 nt, Artificial Sequence
  source: /note="Description of Artificial Sequence: Synthetic oligonucleotide"
uugcuguguagugaccccu

SEQ ID NO: 357 - RNA, 19 nt, Artificial Sequence
  source: /note="Description of Artificial Sequence: Synthetic oligonucleotide"
ugaccccugccugugacgu

SEQ ID NO: 358 - RNA, 19 nt, Artificial Sequence
  source: /note="Description of Artificial Sequence: Synthetic oligonucleotide"
ugugacguggaggauccca

SEQ ID NO: 359 - RNA, 19 nt, Artificial Sequence
  source: /note="Description of Artificial Sequence: Synthetic oligonucleotide"
aggaucccagccucugaga

SEQ ID NO: 360 - RNA, 19 nt, Artificial Sequence
  source: /note="Description of Artificial Sequence: Synthetic oligonucleotide"
cucugagcugaguugguuu

SEQ ID NO: 361 - RNA, 19 nt, Artificial Sequence
  source: /note="Description of Artificial Sequence: Synthetic oligonucleotide"
uugguuuuaugaaaagcua

SEQ ID NO: 362 - RNA, 19 nt, Artificial Sequence
  source: /note="Description of Artificial Sequence: Synthetic oligonucleotide"
aaaagcuaggaagcaaccu

SEQ ID NO: 363 - RNA, 19 nt, Artificial Sequence
  source: /note="Description of Artificial Sequence: Synthetic oligonucleotide"
gaagcaaccuuucgccugu

SEQ ID NO: 364 - RNA, 19 nt, Artificial Sequence
  source: /note="Description of Artificial Sequence: Synthetic oligonucleotide"
ucgccugugcagcggucca

SEQ ID NO: 365 - RNA, 19 nt, Artificial Sequence
  source: /note="Description of Artificial Sequence: Synthetic oligonucleotide"
cgguccagcacuuaacucu

SEQ ID NO: 366 - RNA, 19 nt, Artificial Sequence
  source: /note="Description of Artificial Sequence: Synthetic oligonucleotide"
uuaacucuaauacaucaga

SEQ ID NO: 367 - RNA, 19 nt, Artificial Sequence
  source: /note="Description of Artificial Sequence: Synthetic oligonucleotide"
uacaucagcaugcguuaau

SEQ ID NO: 368 - RNA, 19 nt, Artificial Sequence
  source: /note="Description of Artificial Sequence: Synthetic oligonucleotide"
cguuaauucagcugguuga

SEQ ID NO: 369 - RNA, 19 nt, Artificial Sequence
  source: /note="Description of Artificial Sequence: Synthetic oligonucleotide"
cugguugggaaaugacaca

SEQ ID NO: 370 - RNA, 19 nt, Artificial Sequence
  source: /note="Description of Artificial Sequence: Synthetic oligonucleotide"
aaugacaccaggaagccca

SEQ ID NO: 371 - RNA, 19 nt, Artificial Sequence
  source: /note="Description of Artificial Sequence: Synthetic oligonucleotide"
aagcccagugcagagggua

SEQ ID NO: 372 - RNA, 19 nt, Artificial Sequence
  source: /note="Description of Artificial Sequence: Synthetic oligonucleotide"
agagggucccuuacugacu

SEQ ID NO: 373 - RNA, 19 nt, Artificial Sequence
  source: /note="Description of Artificial Sequence: Synthetic oligonucleotide"
uuacugacuguuucgugga

SEQ ID NO: 374 - RNA, 19 nt, Artificial Sequence
  source: /note="Description of Artificial Sequence: Synthetic oligonucleotide"
uucguggcccuauuaauga

SEQ ID NO: 375 - RNA, 19 nt, Artificial Sequence
  source: /note="Description of Artificial Sequence: Synthetic oligonucleotide"
uuaauggucagacuguuca

SEQ ID NO: 376 - RNA, 19 nt, Artificial Sequence
  source: /note="Description of Artificial Sequence: Synthetic oligonucleotide"
gacuguuccagcaugaggu

SEQ ID NO: 377 - RNA, 19 nt, Artificial Sequence
  source: /note="Description of Artificial Sequence: Synthetic oligonucleotide"
ugagguucuuagaaugaca

SEQ ID NO: 378 - RNA, 19 nt, Artificial Sequence
  source: /note="Description of Artificial Sequence: Synthetic oligonucleotide"
uagaaugacagguguuuga

SEQ ID NO: 379 - RNA, 19 nt, Artificial Sequence
  source: /note="Description of Artificial Sequence: Synthetic oligonucleotide"
uguuuggauggguggggga

SEQ ID NO: 380 - RNA, 19 nt, Artificial Sequence
  source: /note="Description of Artificial Sequence: Synthetic oligonucleotide"
ugggggccuugugauggga

SEQ ID NO: 381 - RNA, 19 nt, Artificial Sequence
  source: /note="Description of Artificial Sequence: Synthetic oligonucleotide"
ugugaugggggguaggcua

SEQ ID NO: 382 - RNA, 19 nt, Artificial Sequence
  source: /note="Description of Artificial Sequence: Synthetic oligonucleotide"
uaggcuggcccauguguga

SEQ ID NO: 383 - RNA, 19 nt, Artificial Sequence
  source: /note="Description of Artificial Sequence: Synthetic oligonucleotide"
ugugugaucuuguggggua

SEQ ID NO: 384 - RNA, 19 nt, Artificial Sequence
  source: /note="Description of Artificial Sequence: Synthetic oligonucleotide"
uugugggguggagggaaga

SEQ ID NO: 385 - RNA, 19 nt, Artificial Sequence
  source: /note="Description of Artificial Sequence: Synthetic oligonucleotide"
agggaagagaauagcauga

SEQ ID NO: 386 - RNA, 19 nt, Artificial Sequence
  source: /note="Description of Artificial Sequence: Synthetic oligonucleotide"
uagcaugaucccacuucca

SEQ ID NO: 387 - RNA, 19 nt, Artificial Sequence
  source: /note="Description of Artificial Sequence: Synthetic oligonucleotide"
acuuccccaugcuguggga

SEQ ID NO: 388 - RNA, 19 nt, Artificial Sequence
  source: /note="Description of Artificial Sequence: Synthetic oligonucleotide"
cugugggaaggggugcagu

SEQ ID NO: 389 - RNA, 19 nt, Artificial Sequence
  source: /note="Description of Artificial Sequence: Synthetic oligonucleotide"
gugcaguucguccccaaga

SEQ ID NO: 390 - RNA, 19 nt, Artificial Sequence
  source: /note="Description of Artificial Sequence: Synthetic oligonucleotide"
uccccaagaacgacacuga

SEQ ID NO: 391 - RNA, 19 nt, Artificial Sequence
  source: /note="Description of Artificial Sequence: Synthetic oligonucleotide"
acacugccugucagguggu

SEQ ID NO: 392 - RNA, 19 nt, Artificial Sequence
  source: /note="Description of Artificial Sequence: Synthetic oligonucleotide"
ucagguggucugcaaagau

SEQ ID NO: 393 - RNA, 19 nt, Artificial Sequence
  source: /note="Description of Artificial Sequence: Synthetic oligonucleotide"
ugcaaagaugauaaccuua

SEQ ID NO: 394 - RNA, 19 nt, Artificial Sequence
  source: /note="Description of Artificial Sequence: Synthetic oligonucleotide"
aaccuugacuacuaaaaac

SEQ ID NO: 395 - RNA, 19 nt, Artificial Sequence
  source: /note="Description of Artificial Sequence: Synthetic oligonucleotide"
uaaaaacgucuccauggca

SEQ ID NO: 396 - RNA, 19 nt, Artificial Sequence
  source: /note="Description of Artificial Sequence: Synthetic oligonucleotide"
ccauggcggggguaacaaa

SEQ ID NO: 397 - RNA, 19 nt, Artificial Sequence
  source: /note="Description of Artificial Sequence: Synthetic oligonucleotide"
gguaacaagaugauaaucu

SEQ ID NO: 398 - RNA, 19 nt, Artificial Sequence
  source: /note="Description of Artificial Sequence: Synthetic oligonucleotide"
ugauaaucuacuuaauuuu

SEQ ID NO: 399 - RNA, 19 nt, Artificial Sequence
  source: /note="Description of Artificial Sequence: Synthetic oligonucleotide"
uuaauuuuagaacaccuuu

SEQ ID NO: 400 - RNA, 19 nt, Artificial Sequence
  source: /note="Description of Artificial Sequence: Synthetic oligonucleotide"
acaccuuuuucaccuaacu

SEQ ID NO: 401 - RNA, 19 nt, Artificial Sequence
  source: /note="Description of Artificial Sequence: Synthetic oligonucleotide"
ccuaacuaaaauaauguuu

SEQ ID NO: 402 - RNA, 19 nt, Artificial Sequence
  source: /note="Description of Artificial Sequence: Synthetic oligonucleotide"
auaauguuuaaagaguuuu

SEQ ID NO: 403 - RNA, 19 nt, Artificial Sequence
  source: /note="Description of Artificial Sequence: Synthetic oligonucleotide"
gaguuuuguauaaaaaugu

SEQ ID NO: 404 - RNA, 19 nt, Artificial Sequence
  source: /note="Description of Artificial Sequence: Synthetic oligonucleotide"
aaaaauguaaggaagcguu

SEQ ID NO: 405 - RNA, 19 nt, Artificial Sequence
  source: /note="Description of Artificial Sequence: Synthetic oligonucleotide"
ggaagcguuguuaccuguu

SEQ ID NO: 406 - RNA, 19 nt, Artificial Sequence
  source: /note="Description of Artificial Sequence: Synthetic oligonucleotide"
uaccuguugaauuuuguau

SEQ ID NO: 407 - RNA, 19 nt, Artificial Sequence
  source: /note="Description of Artificial Sequence: Synthetic oligonucleotide"
uuguauuaugugaaucagu

SEQ ID NO: 408 - RNA, 19 nt, Artificial Sequence
  source: /note="Description of Artificial Sequence: Synthetic oligonucleotide"
gaaucagugagauguuagu

SEQ ID NO: 409 - RNA, 19 nt, Artificial Sequence
  source: /note="Description of Artificial Sequence: Synthetic oligonucleotide"
auguuaguagaauaagccu

SEQ ID NO: 410 - RNA, 19 nt, Artificial Sequence
  source: /note="Description of Artificial Sequence: Synthetic oligonucleotide"
auaagccuuaaaaaaaaaa

SEQ ID NO: 411 - RNA, 19 nt, Artificial Sequence
  source: /note="Description of Artificial Sequence: Synthetic oligonucleotide"
aaaaaaaaaaaaaucgguu

SEQ ID NO: 412 - RNA, 19 nt, Artificial Sequence
  source: /note="Description of Artificial Sequence: Synthetic oligonucleotide"
aaucgguugggugcaguga

SEQ ID NO: 413 - RNA, 19 nt, Artificial Sequence
  source: /note="Description of Artificial Sequence: Synthetic oligonucleotide"
ugcaguggcacacggcugu

SEQ ID NO: 414 - RNA, 19 nt, Artificial Sequence
  source: /note="Description of Artificial Sequence: Synthetic oligonucleotide"
ggcuguaaucccagcacuu

SEQ ID NO: 415 - RNA, 19 nt, Artificial Sequence
  source: /note="Description of Artificial Sequence: Synthetic oligonucleotide"
cagcacuuugggaggccaa

SEQ ID NO: 416 - RNA, 19 nt, Artificial Sequence
  source: /note="Description of Artificial Sequence: Synthetic oligonucleotide"
gaggccaagguuggcagau

SEQ ID NO: 417 - RNA, 19 nt, Artificial Sequence
  source: /note="Description of Artificial Sequence: Synthetic oligonucleotide"
uuggcagaucaccugaggu

SEQ ID NO: 418 - RNA, 19 nt, Artificial Sequence
  source: /note="Description of Artificial Sequence: Synthetic oligonucleotide"
cugaggucaggaguucaaa

SEQ ID NO: 419 - RNA, 19 nt, Artificial Sequence
  source: /note="Description of Artificial Sequence: Synthetic oligonucleotide"
gaguucaagaccagucuga

SEQ ID NO: 420 - RNA, 19 nt, Artificial Sequence
  source: /note="Description of Artificial Sequence: Synthetic oligonucleotide"
cagucuggccaacauagca

SEQ ID NO: 421 - RNA, 19 nt, Artificial Sequence
  source: /note="Description of Artificial Sequence: Synthetic oligonucleotide"
aacauagcaaaacccugua

SEQ ID NO: 422 - RNA, 19 nt, Artificial Sequence
  source: /note="Description of Artificial Sequence: Synthetic oligonucleotide"
cccugucucuacuaaaaau

SEQ ID NO: 423 - RNA, 19 nt, Artificial Sequence
  source: /note="Description of Artificial Sequence: Synthetic oligonucleotide"
cuaaaaauacaaaaauuau

SEQ ID NO: 424 - RNA, 19 nt, Artificial Sequence
  source: /note="Description of Artificial Sequence: Synthetic oligonucleotide"
aaaauuaucugggcauggu

SEQ ID NO: 425 - RNA, 19 nt, Artificial Sequence
  source: /note="Description of Artificial Sequence: Synthetic oligonucleotide"
ggcaugguggugcaugccu

SEQ ID NO: 426 - RNA, 19 nt, Artificial Sequence
  source: /note="Description of Artificial Sequence: Synthetic oligonucleotide"
caugccuguaaucccagcu

SEQ ID NO: 427 - RNA, 19 nt, Artificial Sequence
  source: /note="Description of Artificial Sequence: Synthetic oligonucleotide"
aaucccagcuauucggaaa

SEQ ID NO: 428 - RNA, 19 nt, Artificial Sequence
  source: /note="Description of Artificial Sequence: Synthetic oligonucleotide"
uucggaaggcugaggcaga

SEQ ID NO: 429 - RNA, 19 nt, Artificial Sequence
  source: /note="Description of Artificial Sequence: Synthetic oligonucleotide"
aggcaggagaaucacuuga

SEQ ID NO: 430 - RNA, 19 nt, Artificial Sequence
  source: /note="Description of Artificial Sequence: Synthetic oligonucleotide"
aucacuugaacccaggaga

SEQ ID NO: 431 - RNA, 19 nt, Artificial Sequence
  source: /note="Description of Artificial Sequence: Synthetic oligonucleotide"
caggaggcggagguugcga

SEQ ID NO: 432 - RNA, 19 nt, Artificial Sequence
  source: /note="Description of Artificial Sequence: Synthetic oligonucleotide"
guugcggugagcugagauu

SEQ ID NO: 433 - RNA, 19 nt, Artificial Sequence
  source: /note="Description of Artificial Sequence: Synthetic oligonucleotide"
cugagauugcaccauuuca

SEQ ID NO: 434 - RNA, 19 nt, Artificial Sequence
  source: /note="Description of Artificial Sequence: Synthetic oligonucleotide"
caccauuucauuccagccu

SEQ ID NO: 435 - RNA, 19 nt, Artificial Sequence
  source: /note="Description of Artificial Sequence: Synthetic oligonucleotide"
cagccugggcaacaugagu

SEQ ID NO: 436 - RNA, 19 nt, Artificial Sequence
  source: /note="Description of Artificial Sequence: Synthetic oligonucleotide"
aacaugagugaaagucuga

SEQ ID NO: 437 - RNA, 19 nt, Artificial Sequence
  source: /note="Description of Artificial Sequence: Synthetic oligonucleotide"
agucugacucaaaaaaaaa

SEQ ID NO: 438 - RNA, 19 nt, Artificial Sequence
  source: /note="Description of Artificial Sequence: Synthetic oligonucleotide"
aaaaaaaaaaaauuuaaaa

SEQ ID NO: 439 - RNA, 19 nt, Artificial Sequence
  source: /note="Description of Artificial Sequence: Synthetic oligonucleotide"
uuuaaaaaacaaaauaaua

SEQ ID NO: 440 - RNA, 19 nt, Artificial Sequence
  source: /note="Description of Artificial Sequence: Synthetic oligonucleotide"
aaaauaaucuagugugcaa

SEQ ID NO: 441 - RNA, 19 nt, Artificial Sequence
  source: /note="Description of Artificial Sequence: Synthetic oligonucleotide"
gugugcagggcauucaccu

SEQ ID NO: 442 - RNA, 19 nt, Artificial Sequence
  source: /note="Description of Artificial Sequence: Synthetic oligonucleotide"
cauucaccucagcccccca

SEQ ID NO: 443 - RNA, 19 nt, Artificial Sequence
  source: /note="Description of Artificial Sequence: Synthetic oligonucleotide"
cccccaggcaggagccaaa

SEQ ID NO: 444 - RNA, 19 nt, Artificial Sequence
  source: /note="Description of Artificial Sequence: Synthetic oligonucleotide"
aggagccaagcacagcaga

SEQ ID NO: 445 - RNA, 19 nt, Artificial Sequence
  source: /note="Description of Artificial Sequence: Synthetic oligonucleotide"
acagcaggagcuuccgccu

SEQ ID NO: 446 - RNA, 19 nt, Artificial Sequence
  source: /note="Description of Artificial Sequence: Synthetic oligonucleotide"
uuccgccuccucuccacua

SEQ ID NO: 447 - RNA, 19 nt, Artificial Sequence
  source: /note="Description of Artificial Sequence: Synthetic oligonucleotide"
uccacuggagcacacaacu

SEQ ID NO: 448 - RNA, 19 nt, Artificial Sequence
  source: /note="Description of Artificial Sequence: Synthetic oligonucleotide"
acacaacuugaaccuggcu

SEQ ID NO: 449 - RNA, 19 nt, Artificial Sequence
  source: /note="Description of Artificial Sequence: Synthetic oligonucleotide"
aaccuggcuuauuuucuga

SEQ ID NO: 450 - RNA, 19 nt, Artificial Sequence
  source: /note="Description of Artificial Sequence: Synthetic oligonucleotide"
uucugcagggaccagccca

SEQ ID NO: 451 - RNA, 19 nt, Artificial Sequence
  source: /note="Description of Artificial Sequence: Synthetic oligonucleotide"
ccagccccacauggucagu

SEQ ID NO: 452 - RNA, 19 nt, Artificial Sequence
  source: /note="Description of Artificial Sequence: Synthetic oligonucleotide"
uuucuccccauguguggca

SEQ ID NO: 453 - RNA, 19 nt, Artificial Sequence
  source: /note="Description of Artificial Sequence: Synthetic oligonucleotide"
agagaguguagaaauaaag

SEQ ID NO: 454 - RNA, 19 nt, Artificial Sequence
  source: /note="Description of Artificial Sequence: Synthetic oligonucleotide"
ugacgucagccccgccccc

SEQ ID NO: 455 - RNA, 19 nt, Artificial Sequence
  source: /note="Description of Artificial Sequence: Synthetic oligonucleotide"
ugcauucccagcgcgacgu

SEQ ID NO: 456 - RNA, 19 nt, Artificial Sequence
  source: /note="Description of Artificial Sequence: Synthetic oligonucleotide"
uucucggccagggcauucc

SEQ ID NO: 457 - RNA, 19 nt, Artificial Sequence
  source: /note="Description of Artificial Sequence: Synthetic oligonucleotide"
ugccucagugucucggcca

SEQ ID NO: 458 - RNA, 19 nt, Artificial Sequence
  source: /note="Description of Artificial Sequence: Synthetic oligonucleotide"
ugcucucuacccugccuca

SEQ ID NO: 459 - RNA, 19 nt, Artificial Sequence
  source: /note="Description of Artificial Sequence: Synthetic oligonucleotide"
ucgcccgcaagcgcucucu

SEQ ID NO: 460 - RNA, 19 nt, Artificial Sequence
  source: /note="Description of Artificial Sequence: Synthetic oligonucleotide"
uagcuccgcccggcgcccg

SEQ ID NO: 461 - RNA, 19 nt, Artificial Sequence
  source: /note="Description of Artificial Sequence: Synthetic oligonucleotide"
ugauccgcagcagcuccgc

SEQ ID NO: 462 - RNA, 19 nt, Artificial Sequence
  source: /note="Description of Artificial Sequence: Synthetic oligonucleotide"
ucucggguccugauccgca

SEQ ID NO: 463 - RNA, 19 nt, Artificial Sequence
  source: /note="Description of Artificial Sequence: Synthetic oligonucleotide"
aucgggaaucggcucgggu

SEQ ID NO: 464 - RNA, 19 nt, Artificial Sequence
  source: /note="Description of Artificial Sequence: Synthetic oligonucleotide"
ucugggucgggaucgggaa

SEQ ID NO: 465 - RNA, 19 nt, Artificial Sequence
  source: /note="Description of Artificial Sequence: Synthetic oligonucleotide"
ugcggguuaggaucugggu

SEQ ID NO: 466 - RNA, 19 nt, Artificial Sequence
  source: /note="Description of Artificial Sequence: Synthetic oligonucleotide"
ugggcgggggcgcggguua

SEQ ID NO: 467 - RNA, 19 nt, Artificial Sequence
  source: /note="Description of Artificial Sequence: Synthetic oligonucleotide"
ugcggcggcggcggggcgg

SEQ ID NO: 468 - RNA, 19 nt, Artificial Sequence
  source: /note="Description of Artificial Sequence: Synthetic oligonucleotide"
ugcgucguacauggcggcg

SEQ ID NO: 469 - RNA, 19 nt, Artificial Sequence
  source: /note="Description of Artificial Sequence: Synthetic oligonucleotide"
agccgcgcucugcgucgua

SEQ ID NO: 470 - RNA, 19 nt, Artificial Sequence
  source: /note="Description of Artificial Sequence: Synthetic oligonucleotide"
aggacaagcuccagccgcg

SEQ ID NO: 471 - RNA, 19 nt, Artificial Sequence
  source: /note="Description of Artificial Sequence: Synthetic oligonucleotide"
agcccgcgaaggacaagcu

SEQ ID NO: 472 - RNA, 19 nt, Artificial Sequence
  source: /note="Description of Artificial Sequence: Synthetic oligonucleotide"
uaggaagccgcagcccgcg

SEQ ID NO: 473 - RNA, 19 nt, Artificial Sequence
  source: /note="Description of Artificial Sequence: Synthetic oligonucleotide"
ugugguagaagcccaggaa

SEQ ID NO: 474 - RNA, 19 nt, Artificial Sequence
  source: /note="Description of Artificial Sequence: Synthetic oligonucleotide"
ucgccccgacgugguagaa

SEQ ID NO: 475 - RNA, 19 nt, Artificial Sequence
  source: /note="Description of Artificial Sequence: Synthetic oligonucleotide"
uaggcagcgggucgccccg

SEQ ID NO: 476 - RNA, 19 nt, Artificial Sequence
  source: /note="Description of Artificial Sequence: Synthetic oligonucleotide"
uggcgugcucgcucaggca

SEQ ID NO: 477 - RNA, 19 nt, Artificial Sequence
  source: /note="Description of Artificial Sequence: Synthetic oligonucleotide"
aggaggugcggggcgugcu

SEQ ID NO: 478 - RNA, 19 nt, Artificial Sequence
  source: /note="Description of Artificial Sequence: Synthetic oligonucleotide"
ugcgcgucgcggaggaggu

SEQ ID NO: 479 - RNA, 19 nt, Artificial Sequence
  source: /note="Description of Artificial Sequence: Synthetic oligonucleotide"
aacaacaugcgcgcgucgc

SEQ ID NO: 480 - RNA, 19 nt, Artificial Sequence
  source: /note="Description of Artificial Sequence: Synthetic oligonucleotide"
uccgaagcgccgaacaaca

SEQ ID NO: 481 - RNA, 19 nt, Artificial Sequence
  source: /note="Description of Artificial Sequence: Synthetic oligonucleotide"
ugcaacgccccggccgaag

SEQ ID NO: 482 - RNA, 19 nt, Artificial Sequence
  source: /note="Description of Artificial Sequence: Synthetic oligonucleotide"
uccgacgcagugcaacgcc

SEQ ID NO: 483 - RNA, 19 nt, Artificial Sequence
  source: /note="Description of Artificial Sequence: Synthetic oligonucleotide"
uggagaggacgccgacgca

SEQ ID NO: 484 - RNA, 19 nt, Artificial Sequence
  source: /note="Description of Artificial Sequence: Synthetic oligonucleotide"
uccagcgggauaccggaga

SEQ ID NO: 485 - RNA, 19 nt, Artificial Sequence
  source: /note="Description of Artificial Sequence: Synthetic oligonucleotide"
agagucugcuccagcggga

SEQ ID NO: 486 - RNA, 19 nt, Artificial Sequence
  source: /note="Description of Artificial Sequence: Synthetic oligonucleotide"
agaggaccugcagagucug

SEQ ID NO: 487 - RNA, 19 nt, Artificial Sequence
  source: /note="Description of Artificial Sequence: Synthetic oligonucleotide"
ugcacaagaucugagagga

SEQ ID NO: 488 - RNA, 19 nt, Artificial Sequence
  source: /note="Description of Artificial Sequence: Synthetic oligonucleotide"
ucuggccuuccgcacaaga

SEQ ID NO: 489 - RNA, 19 nt, Artificial Sequence
  source: /note="Description of Artificial Sequence: Synthetic oligonucleotide"
uguuccgacuccuggccuu

SEQ ID NO: 490 - RNA, 19 nt, Artificial Sequence
  source: /note="Description of Artificial Sequence: Synthetic oligonucleotide"
ugaagaugccaauguuccg

SEQ ID NO: 491 - RNA, 19 nt, Artificial Sequence
  source: /note="Description of Artificial Sequence: Synthetic oligonucleotide"
aaggauggauggaagaugc

SEQ ID NO: 492 - RNA, 19 nt, Artificial Sequence
  source: /note="Description of Artificial Sequence: Synthetic oligonucleotide"
ugcuuaaguugaaggaugg

SEQ ID NO: 493 - RNA, 19 nt, Artificial Sequence
  source: /note="Description of Artificial Sequence: Synthetic oligonucleotide"
uucggaggaacuugcuuaa

SEQ ID NO: 494 - RNA, 19 nt, Artificial Sequence
  source: /note="Description of Artificial Sequence: Synthetic oligonucleotide"
ucagagacccugucggagg

SEQ ID NO: 495 - RNA, 19 nt, Artificial Sequence
  source: /note="Description of Artificial Sequence: Synthetic oligonucleotide"
ugggaggcauuugcagaga

SEQ ID NO: 496 - RNA, 19 nt, Artificial Sequence
  source: /note="Description of Artificial Sequence: Synthetic oligonucleotide"
ugacauuggccgggaggca

SEQ ID NO: 497 - RNA, 19 nt, Artificial Sequence
  source: /note="Description of Artificial Sequence: Synthetic oligonucleotide"
agaugagcugguggacauu

SEQ ID NO: 498 - RNA, 19 nt, Artificial Sequence
  source: /note="Description of Artificial Sequence: Synthetic oligonucleotide"
auuuugccggagaugagcu

SEQ ID NO: 499 - RNA, 19 nt, Artificial Sequence
  source: /note="Description of Artificial Sequence: Synthetic oligonucleotide"
agagaugccuauuuugccg

SEQ ID NO: 500 - RNA, 19 nt, Artificial Sequence
  source: /note="Description of Artificial Sequence: Synthetic oligonucleotide"
acacucugguaagagagau

SEQ ID NO: 501 - RNA, 19 nt, Artificial Sequence
  source: /note="Description of Artificial Sequence: Synthetic oligonucleotide"
ucccaucagacacucuggu

SEQ ID NO: 502 - RNA, 19 nt, Artificial Sequence
  source: /note="Description of Artificial Sequence: Synthetic oligonucleotide"
accagaacguuuuccccau

SEQ ID NO: 503 - RNA, 19 nt, Artificial Sequence
  source: /note="Description of Artificial Sequence: Synthetic oligonucleotide"
aagucagacaccagaacgu

SEQ ID NO: 504 - RNA, 19 nt, Artificial Sequence
  source: /note="Description of Artificial Sequence: Synthetic oligonucleotide"
cuuuggaccgaaagucaga

SEQ ID NO: 505 - RNA, 19 nt, Artificial Sequence
  source: /note="Description of Artificial Sequence: Synthetic oligonucleotide"
ucacgacuucgucuuugga

SEQ ID NO: 506 - RNA, 19 nt, Artificial Sequence
  source: /note="Description of Artificial Sequence: Synthetic oligonucleotide"
accaaggcauccacgacuu

SEQ ID NO: 507 - RNA, 19 nt, Artificial Sequence
  source: /note="Description of Artificial Sequence: Synthetic oligonucleotide"
aagcaggaacauaccaagg

SEQ ID NO: 508 - RNA, 19 nt, Artificial Sequence
  source: /note="Description of Artificial Sequence: Synthetic oligonucleotide"
agaaggggaugaagcagga

SEQ ID NO: 509 - RNA, 19 nt, Artificial Sequence
  source: /note="Description of Artificial Sequence: Synthetic oligonucleotide"
aggccacuguagaagggga

SEQ ID NO: 510 - RNA, 19 nt, Artificial Sequence
  source: /note="Description of Artificial Sequence: Synthetic oligonucleotide"
aaggagggauaaggccacu

SEQ ID NO: 511 - RNA, 19 nt, Artificial Sequence
  source: /note="Description of Artificial Sequence: Synthetic oligonucleotide"
ugccucugaaggaaggagg

SEQ ID NO: 512 - RNA, 19 nt, Artificial Sequence
  source: /note="Description of Artificial Sequence: Synthetic oligonucleotide"
acauaucgcacgccucuga

SEQ ID NO: 513 - RNA, 19 nt, Artificial Sequence
  source: /note="Description of Artificial Sequence: Synthetic oligonucleotide"
acuccuccauccacauauc

SEQ ID NO: 514 - RNA, 19 nt, Artificial Sequence
  source: /note="Description of Artificial Sequence: Synthetic oligonucleotide"
acguugucacucacuccuc

SEQ ID NO: 515 - RNA, 19 nt, Artificial Sequence
  source: /note="Description of Artificial Sequence: Synthetic oligonucleotide"
aaugaaggguacguuguca

SEQ ID NO: 516 - RNA, 19 nt, Artificial Sequence
  source: /note="Description of Artificial Sequence: Synthetic oligonucleotide"
guuuuggcaucaaugaagg

SEQ ID NO: 517 - RNA, 19 nt, Artificial Sequence
  source: /note="Description of Artificial Sequence: Synthetic oligonucleotide"
ugugaugguuguuuuggca

SEQ ID NO: 518 - RNA, 19 nt, Artificial Sequence
  source: /note="Description of Artificial Sequence: Synthetic oligonucleotide"
agaagggggacacggugau

SEQ ID NO: 519 - RNA, 19 nt, Artificial Sequence
  source: /note="Description of Artificial Sequence: Synthetic oligonucleotide"
acuccccauagaaggggga

SEQ ID NO: 520 - RNA, 19 nt, Artificial Sequence
  source: /note="Description of Artificial Sequence: Synthetic oligonucleotide"
ucagaugucguacucccca

SEQ ID NO: 521 - RNA, 19 nt, Artificial Sequence
  source: /note="Description of Artificial Sequence: Synthetic oligonucleotide"
acuugacuuuagggcagau

SEQ ID NO: 522 - RNA, 19 nt, Artificial Sequence
  source: /note="Description of Artificial Sequence: Synthetic oligonucleotide"
aaaguucguggacuugacu

SEQ ID NO: 523 - RNA, 19 nt, Artificial Sequence
  source: /note="Description of Artificial Sequence: Synthetic oligonucleotide"
ucacaugaagaaaguucgu

SEQ ID NO: 524 - RNA, 19 nt, Artificial Sequence
  source: /note="Description of Artificial Sequence: Synthetic oligonucleotide"
uuggugauguccacaugaa

SEQ ID NO: 525 - RNA, 19 nt, Artificial Sequence
  source: /note="Description of Artificial Sequence: Synthetic oligonucleotide"
uguagacugagcuugguga

SEQ ID NO: 526 - RNA, 19 nt, Artificial Sequence
  source: /note="Description of Artificial Sequence: Synthetic oligonucleotide"
uugugcagaggcguagacu

SEQ ID NO: 527 - RNA, 19 nt, Artificial Sequence
  source: /note="Description of Artificial Sequence: Synthetic oligonucleotide"
uuagagguucccugugcag

SEQ ID NO: 528 - RNA, 19 nt, Artificial Sequence
  source: /note="Description of Artificial Sequence: Synthetic oligonucleotide"
ucgagagaagguagagguu

SEQ ID NO: 529 - RNA, 19 nt, Artificial Sequence
  source: /note="Description of Artificial Sequence: Synthetic oligonucleotide"
uggacaaaagcucucgaga

SEQ ID NO: 530 - RNA, 19 nt, Artificial Sequence
  source: /note="Description of Artificial Sequence: Synthetic oligonucleotide"
ugagauccggggggacaaa

SEQ ID NO: 531 - RNA, 19 nt, Artificial Sequence
  source: /note="Description of Artificial Sequence: Synthetic oligonucleotide"
ucagcaccuugagauccgg

SEQ ID NO: 532 - RNA, 19 nt, Artificial Sequence
  source: /note="Description of Artificial Sequence: Synthetic oligonucleotide"
aggcauaucucucccagca

SEQ ID NO: 533 - RNA, 19 nt, Artificial Sequence
  source: /note="Description of Artificial Sequence: Synthetic oligonucleotide"
uauccucgaaggcauaucu

SEQ ID NO: 534 - RNA, 19 nt, Artificial Sequence
  source: /note="Description of Artificial Sequence: Synthetic oligonucleotide"
uaaugcauccaaauauccu

SEQ ID NO: 535 - RNA, 19 nt, Artificial Sequence
  source: /note="Description of Artificial Sequence: Synthetic oligonucleotide"
uccaagaaccugaaugcau

SEQ ID NO: 536 - RNA, 19 nt, Artificial Sequence
  source: /note="Description of Artificial Sequence: Synthetic oligonucleotide"
ugcccuucucuuccaagaa

SEQ ID NO: 537 - RNA, 19 nt, Artificial Sequence
  source: /note="Description of Artificial Sequence: Synthetic oligonucleotide"
uguugcagaugcccuucuc

SEQ ID NO: 538 - RNA, 19 nt, Artificial Sequence
  source: /note="Description of Artificial Sequence: Synthetic oligonucleotide"
uuggcuggggccuguugca

SEQ ID NO: 539 - RNA, 19 nt, Artificial Sequence
  source: /note="Description of Artificial Sequence: Synthetic oligonucleotide"
augacuucaggccuggcug

SEQ ID NO: 540 - RNA, 19 nt, Artificial Sequence
  source: /note="Description of Artificial Sequence: Synthetic oligonucleotide"
uccuucugaggaugacuuc

SEQ ID NO: 541 - RNA, 19 nt, Artificial Sequence
  source: /note="Description of Artificial Sequence: Synthetic oligonucleotide"
uaggauccaucccuucuga

SEQ ID NO: 542 - RNA, 19 nt, Artificial Sequence
  source: /note="Description of Artificial Sequence: Synthetic oligonucleotide"
auggcgaccucaggaucca

SEQ ID NO: 543 - RNA, 19 nt, Artificial Sequence
  source: /note="Description of Artificial Sequence: Synthetic oligonucleotide"
ugcccagcugggcauggcg

SEQ ID NO: 544 - RNA, 19 nt, Artificial Sequence
  source: /note="Description of Artificial Sequence: Synthetic oligonucleotide"
acucauguuugcccagcug

SEQ ID NO: 545 - RNA, 19 nt, Artificial Sequence
  source: /note="Description of Artificial Sequence: Synthetic oligonucleotide"
ugaagaauccagacucaug

SEQ ID NO: 546 - RNA, 19 nt, Artificial Sequence
  source: /note="Description of Artificial Sequence: Synthetic oligonucleotide"
agccgacuccggggaagaa

SEQ ID NO: 547 - RNA, 19 nt, Artificial Sequence
  source: /note="Description of Artificial Sequence: Synthetic oligonucleotide"
acagccaaggcagccgacu

SEQ ID NO: 548 - RNA, 19 nt, Artificial Sequence
  source: /note="Description of Artificial Sequence: Synthetic oligonucleotide"
ucuccagccucacagccaa

SEQ ID NO: 549 - RNA, 19 nt, Artificial Sequence
  source: /note="Description of Artificial Sequence: Synthetic oligonucleotide"
ucucaucucccuccagccu

SEQ ID NO: 550 - RNA, 19 nt, Artificial Sequence
  source: /note="Description of Artificial Sequence: Synthetic oligonucleotide"
agguggucuagcagcucau

SEQ ID NO: 551 - RNA, 19 nt, Artificial Sequence
  source: /note="Description of Artificial Sequence: Synthetic oligonucleotide"
uugagacgcagguggucua

SEQ ID NO: 552 - RNA, 19 nt, Artificial Sequence
  source: /note="Description of Artificial Sequence: Synthetic oligonucleotide"
agggcaggaugcugagacg

SEQ ID NO: 553 - RNA, 19 nt, Artificial Sequence
  source: /note="Description of Artificial Sequence: Synthetic oligonucleotide"
ucucucaucccagggcagg

SEQ ID NO: 554 - RNA, 19 nt, Artificial Sequence
  source: /note="Description of Artificial Sequence: Synthetic oligonucleotide"
uuguccaggaugcucucau

SEQ ID NO: 555 - RNA, 19 nt, Artificial Sequence
  source: /note="Description of Artificial Sequence: Synthetic oligonucleotide"
uugggcgagagggugucca

SEQ ID NO: 556 - RNA, 19 nt, Artificial Sequence
  source: /note="Description of Artificial Sequence: Synthetic oligonucleotide"
uuguagcgagccugggcga

SEQ ID NO: 557 - RNA, 19 nt, Artificial Sequence
  source: /note="Description of Artificial Sequence: Synthetic oligonucleotide"
ucacucagugcuguagcga

SEQ ID NO: 558 - RNA, 19 nt, Artificial Sequence
  source: /note="Description of Artificial Sequence: Synthetic oligonucleotide"
cuuucauuucuucacucag

SEQ ID NO: 559 - RNA, 19 nt, Artificial Sequence
  source: /note="Description of Artificial Sequence: Synthetic oligonucleotide"
auccaccuuugucuuucau

SEQ ID NO: 560 - RNA, 19 nt, Artificial Sequence
  source: /note="Description of Artificial Sequence: Synthetic oligonucleotide"
uugcucauguauccaccuu

SEQ ID NO: 561 - RNA, 19 nt, Artificial Sequence
  source: /note="Description of Artificial Sequence: Synthetic oligonucleotide"
aguugcaaaucuugcucau

SEQ ID NO: 562 - RNA, 19 nt, Artificial Sequence
  source: /note="Description of Artificial Sequence: Synthetic oligonucleotide"
aauggguagcaaguugcaa

SEQ ID NO: 563 - RNA, 19 nt, Artificial Sequence
  source: /note="Description of Artificial Sequence: Synthetic oligonucleotide"
agacauuauccuaaugggu

SEQ ID NO: 564 - RNA, 19 nt, Artificial Sequence
  source: /note="Description of Artificial Sequence: Synthetic oligonucleotide"
agcauuacauaagacauua

SEQ ID NO: 565 - RNA, 19 nt, Artificial Sequence
  source: /note="Description of Artificial Sequence: Synthetic oligonucleotide"
aggguacagggcagcauua

SEQ ID NO: 566 - RNA, 19 nt, Artificial Sequence
  source: /note="Description of Artificial Sequence: Synthetic oligonucleotide"
auuccacaggcaggguaca

SEQ ID NO: 567 - RNA, 19 nt, Artificial Sequence
  source: /note="Description of Artificial Sequence: Synthetic oligonucleotide"
ugcaauggcagauuccaca

SEQ ID NO: 568 - RNA, 19 nt, Artificial Sequence
  source: /note="Description of Artificial Sequence: Synthetic oligonucleotide"
uuggacaaucgcaauggca

SEQ ID NO: 569 - RNA, 19 nt, Artificial Sequence
  source: /note="Description of Artificial Sequence: Synthetic oligonucleotide"
uucaccagucucuggacaa

SEQ ID NO: 570 - RNA, 19 nt, Artificial Sequence
  source: /note="Description of Artificial Sequence: Synthetic oligonucleotide"
aucuggaagccaugucacc

SEQ ID NO: 571 - RNA, 19 nt, Artificial Sequence
  source: /note="Description of Artificial Sequence: Synthetic oligonucleotide"
ucgucgggcauaucuggaa

SEQ ID NO: 572 - RNA, 19 nt, Artificial Sequence
  source: /note="Description of Artificial Sequence: Synthetic oligonucleotide"
uacaggacaucgucgggca

SEQ ID NO: 573 - RNA, 19 nt, Artificial Sequence
  source: /note="Description of Artificial Sequence: Synthetic oligonucleotide"
acccacugcaaccacagga

SEQ ID NO: 574 - RNA, 19 nt, Artificial Sequence
  source: /note="Description of Artificial Sequence: Synthetic oligonucleotide"
accugugaggucacccacu

SEQ ID NO: 575 - RNA, 19 nt, Artificial Sequence
  source: /note="Description of Artificial Sequence: Synthetic oligonucleotide"
uucgagugaacaccuguga

SEQ ID NO: 576 - RNA, 19 nt, Artificial Sequence
  source: /note="Description of Artificial Sequence: Synthetic oligonucleotide"
acaucagcacucgagugaa

SEQ ID NO: 577 - RNA, 19 nt, Artificial Sequence
  source: /note="Description of Artificial Sequence: Synthetic oligonucleotide"
ucggggagcagacacauca

SEQ ID NO: 578 - RNA, 19 nt, Artificial Sequence
  source: /note="Description of Artificial Sequence: Synthetic oligonucleotide"
uaccuggaggcggggagca

SEQ ID NO: 579 - RNA, 19 nt, Artificial Sequence
  source: /note="Description of Artificial Sequence: Synthetic oligonucleotide"
acuggcauuugggaccugg

SEQ ID NO: 580 - RNA, 19 nt, Artificial Sequence
  source: /note="Description of Artificial Sequence: Synthetic oligonucleotide"
uuggcugcucacuggcauu

SEQ ID NO: 581 - RNA, 19 nt, Artificial Sequence
  source: /note="Description of Artificial Sequence: Synthetic oligonucleotide"
auggggaggccuguuggcu

SEQ ID NO: 582 - RNA, 19 nt, Artificial Sequence
  source: /note="Description of Artificial Sequence: Synthetic oligonucleotide"
ucaggugugcauggggagg

SEQ ID NO: 583 - RNA, 19 nt, Artificial Sequence
  source: /note="Description of Artificial Sequence: Synthetic oligonucleotide"
ugccaguccugcucaggug

SEQ ID NO: 584 - RNA, 19 nt, Artificial Sequence
  source: /note="Description of Artificial Sequence: Synthetic oligonucleotide"
uaguccagcagggccaguc

SEQ ID NO: 585 - RNA, 19 nt, Artificial Sequence
  source: /note="Description of Artificial Sequence: Synthetic oligonucleotide"
uggagcagggaguccagca

SEQ ID NO: 586 - RNA, 19 nt, Artificial Sequence
  source: /note="Description of Artificial Sequence: Synthetic oligonucleotide"
acagcccuugggggagcag

SEQ ID NO: 587 - RNA, 19 nt, Artificial Sequence
  source: /note="Description of Artificial Sequence: Synthetic oligonucleotide"
uucucugcuggacagcccu

SEQ ID NO: 588 - RNA, 19 nt, Artificial Sequence
  source: /note="Description of Artificial Sequence: Synthetic oligonucleotide"
uccucugcuuuggucucug

SEQ ID NO: 589 - RNA, 19 nt, Artificial Sequence
  source: /note="Description of Artificial Sequence: Synthetic oligonucleotide"
ucgcgggguggccucugcu

SEQ ID NO: 590 - RNA, 19 nt, Artificial Sequence
  source: /note="Description of Artificial Sequence: Synthetic oligonucleotide"
accugaggauggaccgcgg

SEQ ID NO: 591 - RNA, 19 nt, Artificial Sequence
  source: /note="Description of Artificial Sequence: Synthetic oligonucleotide"
uuucaggcuggaccugagg

SEQ ID NO: 592 - RNA, 19 nt, Artificial Sequence
  source: /note="Description of Artificial Sequence: Synthetic oligonucleotide"
ucaagaagaaguucaggcu

SEQ ID NO: 593 - RNA, 19 nt, Artificial Sequence
  source: /note="Description of Artificial Sequence: Synthetic oligonucleotide"
uuacuuuauugcccaagaa

SEQ ID NO: 594 - RNA, 19 nt, Artificial Sequence
  source: /note="Description of Artificial Sequence: Synthetic oligonucleotide"
agcaccagcagguacuuua

SEQ ID NO: 595 - RNA, 19 nt, Artificial Sequence
  source: /note="Description of Artificial Sequence: Synthetic oligonucleotide"
uagagccccucagcaccag

SEQ ID NO: 596 - RNA, 19 nt, Artificial Sequence
  source: /note="Description of Artificial Sequence: Synthetic oligonucleotide"
ugaaagguggagagccccu

SEQ ID NO: 597 - RNA, 19 nt, Artificial Sequence
  source: /note="Description of Artificial Sequence: Synthetic oligonucleotide"
agugaaaaacugggaaagg

SEQ ID NO: 598 - RNA, 19 nt, Artificial Sequence
  source: /note="Description of Artificial Sequence: Synthetic oligonucleotide"
acucuucucuagugaaaaa

SEQ ID NO: 599 - RNA, 19 nt, Artificial Sequence
  source: /note="Description of Artificial Sequence: Synthetic oligonucleotide"
aagugacucacagacucuu

SEQ ID NO: 600 - RNA, 19 nt, Artificial Sequence
  source: /note="Description of Artificial Sequence: Synthetic oligonucleotide"
uucgccuccucaagugacu

SEQ ID NO: 601 - RNA, 19 nt, Artificial Sequence
  source: /note="Description of Artificial Sequence: Synthetic oligonucleotide"
ucugcuagacucgccuccu

SEQ ID NO: 602 - RNA, 19 nt, Artificial Sequence
  source: /note="Description of Artificial Sequence: Synthetic oligonucleotide"
accucugaaagaaucugcu

SEQ ID NO: 603 - RNA, 19 nt, Artificial Sequence
  source: /note="Description of Artificial Sequence: Synthetic oligonucleotide"
aaacuuuagcaccucugaa

SEQ ID NO: 604 - RNA, 19 nt, Artificial Sequence
  source: /note="Description of Artificial Sequence: Synthetic oligonucleotide"
acaaagaugggaaacuuua

SEQ ID NO: 605 - RNA, 19 nt, Artificial Sequence
  source: /note="Description of Artificial Sequence: Synthetic oligonucleotide"
ugagguagcugcacaaaga

SEQ ID NO: 606 - RNA, 19 nt, Artificial Sequence
  source: /note="Description of Artificial Sequence: Synthetic oligonucleotide"
uagcaaugcggagguagcu

SEQ ID NO: 607 - RNA, 19 nt, Artificial Sequence
  source: /note="Description of Artificial Sequence: Synthetic oligonucleotide"
aggggucacuacacagcaa

SEQ ID NO: 608 - RNA, 19 nt, Artificial Sequence
  source: /note="Description of Artificial Sequence: Synthetic oligonucleotide"
acgucacaggcagggguca

SEQ ID NO: 609 - RNA, 19 nt, Artificial Sequence
  source: /note="Description of Artificial Sequence: Synthetic oligonucleotide"
ugggauccuccacgucaca

SEQ ID NO: 610 - RNA, 19 nt, Artificial Sequence
  source: /note="Description of Artificial Sequence: Synthetic oligonucleotide"
ucucagaggcugggauccu

SEQ ID NO: 611 - RNA, 19 nt, Artificial Sequence
  source: /note="Description of Artificial Sequence: Synthetic oligonucleotide"
aaaccaacucagcucagag

SEQ ID NO: 612 - RNA, 19 nt, Artificial Sequence
  source: /note="Description of Artificial Sequence: Synthetic oligonucleotide"
uagcuuuucauaaaaccaa

SEQ ID NO: 613 - RNA, 19 nt, Artificial Sequence
  source: /note="Description of Artificial Sequence: Synthetic oligonucleotide"
agguugcuuccuagcuuuu

SEQ ID NO: 614 - RNA, 19 nt, Artificial Sequence
  source: /note="Description of Artificial Sequence: Synthetic oligonucleotide"
acaggcgaaagguugcuuc

SEQ ID NO: 615 - RNA, 19 nt, Artificial Sequence
  source: /note="Description of Artificial Sequence: Synthetic oligonucleotide"
uggaccgcugcacaggcga

SEQ ID NO: 616 - RNA, 19 nt, Artificial Sequence
  source: /note="Description of Artificial Sequence: Synthetic oligonucleotide"
agaguuaagugcuggaccg

SEQ ID NO: 617 - RNA, 19 nt, Artificial Sequence
  source: /note="Description of Artificial Sequence: Synthetic oligonucleotide"
ucugauguauuagaguuaa

SEQ ID NO: 618 - RNA, 19 nt, Artificial Sequence
  source: /note="Description of Artificial Sequence: Synthetic oligonucleotide"
auuaacgcaugcugaugua

SEQ ID NO: 619 - RNA, 19 nt, Artificial Sequence
  source: /note="Description of Artificial Sequence: Synthetic oligonucleotide"
ucaaccagcugaauuaacg

SEQ ID NO: 620 - RNA, 19 nt, Artificial Sequence
  source: /note="Description of Artificial Sequence: Synthetic oligonucleotide"
ugugucauuucccaaccag

SEQ ID NO: 621 - RNA, 19 nt, Artificial Sequence
  source: /note="Description of Artificial Sequence: Synthetic oligonucleotide"
ugggcuuccuggugucauu

SEQ ID NO: 622 - RNA, 19 nt, Artificial Sequence
  source: /note="Description of Artificial Sequence: Synthetic oligonucleotide"
uacccucugcacugggcuu

SEQ ID NO: 623 - RNA, 19 nt, Artificial Sequence
  source: /note="Description of Artificial Sequence: Synthetic oligonucleotide"
agucaguaagggacccucu

SEQ ID NO: 624 - RNA, 19 nt, Artificial Sequence
  source: /note="Description of Artificial Sequence: Synthetic oligonucleotide"
uccacgaaacagucaguaa

SEQ ID NO: 625 - RNA, 19 nt, Artificial Sequence
  source: /note="Description of Artificial Sequence: Synthetic oligonucleotide"
ucauuaauagggccacgaa

SEQ ID NO: 626 - RNA, 19 nt, Artificial Sequence
  source: /note="Description of Artificial Sequence: Synthetic oligonucleotide"
ugaacagucugaccauuaa

SEQ ID NO: 627 - RNA, 19 nt, Artificial Sequence
  source: /note="Description of Artificial Sequence: Synthetic oligonucleotide"
accucaugcuggaacaguc

SEQ ID NO: 628 - RNA, 19 nt, Artificial Sequence
  source: /note="Description of Artificial Sequence: Synthetic oligonucleotide"
ugucauucuaagaaccuca

SEQ ID NO: 629 - RNA, 19 nt, Artificial Sequence
  source: /note="Description of Artificial Sequence: Synthetic oligonucleotide"
ucaaacaccugucauucua

SEQ ID NO: 630 - RNA, 19 nt, Artificial Sequence
  source: /note="Description of Artificial Sequence: Synthetic oligonucleotide"
ucccccacccauccaaaca

SEQ ID NO: 631 - RNA, 19 nt, Artificial Sequence
  source: /note="Description of Artificial Sequence: Synthetic oligonucleotide"
ucccaucacaaggccccca

SEQ ID NO: 632 - RNA, 19 nt, Artificial Sequence
  source: /note="Description of Artificial Sequence: Synthetic oligonucleotide"
uagccuaccccccaucaca

SEQ ID NO: 633 - RNA, 19 nt, Artificial Sequence
  source: /note="Description of Artificial Sequence: Synthetic oligonucleotide"
ucacacaugggccagccua

SEQ ID NO: 634 - RNA, 19 nt, Artificial Sequence
  source: /note="Description of Artificial Sequence: Synthetic oligonucleotide"
uaccccacaagaucacaca

SEQ ID NO: 635 - RNA, 19 nt, Artificial Sequence
  source: /note="Description of Artificial Sequence: Synthetic oligonucleotide"
ucuucccuccaccccacaa

SEQ ID NO: 636 - RNA, 19 nt, Artificial Sequence
  source: /note="Description of Artificial Sequence: Synthetic oligonucleotide"
ucaugcuauucucuucccu

SEQ ID NO: 637 - RNA, 19 nt, Artificial Sequence
  source: /note="Description of Artificial Sequence: Synthetic oligonucleotide"
uggaagugggaucaugcua

SEQ ID NO: 638 - RNA, 19 nt, Artificial Sequence
  source: /note="Description of Artificial Sequence: Synthetic oligonucleotide"
ucccacagcauggggaagu

SEQ ID NO: 639 - RNA, 19 nt, Artificial Sequence
  source: /note="Description of Artificial Sequence: Synthetic oligonucleotide"
acugcaccccuucccacag

SEQ ID NO: 640 - RNA, 19 nt, Artificial Sequence
  source: /note="Description of Artificial Sequence: Synthetic oligonucleotide"
ucuuggggacgaacugcac

SEQ ID NO: 641 - RNA, 19 nt, Artificial Sequence
  source: /note="Description of Artificial Sequence: Synthetic oligonucleotide"
ucagugucguucuugggga

SEQ ID NO: 642 - RNA, 19 nt, Artificial Sequence
  source: /note="Description of Artificial Sequence: Synthetic oligonucleotide"
accaccugacaggcagugu

SEQ ID NO: 643 - RNA, 19 nt, Artificial Sequence
  source: /note="Description of Artificial Sequence: Synthetic oligonucleotide"
aucuuugcagaccaccuga

SEQ ID NO: 644 - RNA, 19 nt, Artificial Sequence
  source: /note="Description of Artificial Sequence: Synthetic oligonucleotide"
uaagguuaucaucuuugca

SEQ ID NO: 645 - RNA, 19 nt, Artificial Sequence
  source: /note="Description of Artificial Sequence: Synthetic oligonucleotide"
guuuuuaguagucaagguu

SEQ ID NO: 646 - RNA, 19 nt, Artificial Sequence
  source: /note="Description of Artificial Sequence: Synthetic oligonucleotide"
ugccauggagacguuuuua

SEQ ID NO: 647 - RNA, 19 nt, Artificial Sequence
  source: /note="Description of Artificial Sequence: Synthetic oligonucleotide"
uuuguuacccccgccaugg

SEQ ID NO: 648 - RNA, 19 nt, Artificial Sequence
  source: /note="Description of Artificial Sequence: Synthetic oligonucleotide"
agauuaucaucuuguuacc

SEQ ID NO: 649 - RNA, 19 nt, Artificial Sequence
  source: /note="Description of Artificial Sequence: Synthetic oligonucleotide"
aaaauuaaguagauuauca

SEQ ID NO: 650 - RNA, 19 nt, Artificial Sequence
  source: /note="Description of Artificial Sequence: Synthetic oligonucleotide"
aaagguguucuaaaauuaa

SEQ ID NO: 651 - RNA, 19 nt, Artificial Sequence
  source: /note="Description of Artificial Sequence: Synthetic oligonucleotide"
aguuaggugaaaaaggugu

SEQ ID NO: 652 - RNA, 19 nt, Artificial Sequence
  source: /note="Description of Artificial Sequence: Synthetic oligonucleotide"
aaacauuauuuuaguuagg

SEQ ID NO: 653 - RNA, 19 nt, Artificial Sequence
  source: /note="Description of Artificial Sequence: Synthetic oligonucleotide"
aaaacucuuuaaacauuau

SEQ ID NO: 654 - RNA, 19 nt, Artificial Sequence
  source: /note="Description of Artificial Sequence: Synthetic oligonucleotide"
acauuuuuauacaaaacuc

SEQ ID NO: 655 - RNA, 19 nt, Artificial Sequence
  source: /note="Description of Artificial Sequence: Synthetic oligonucleotide"
aacgcuuccuuacauuuuu

SEQ ID NO: 656 - RNA, 19 nt, Artificial Sequence
  source: /note="Description of Artificial Sequence: Synthetic oligonucleotide"
aacagguaacaacgcuucc

SEQ ID NO: 657 - RNA, 19 nt, Artificial Sequence
  source: /note="Description of Artificial Sequence: Synthetic oligonucleotide"
auacaaaauucaacaggua

SEQ ID NO: 658 - RNA, 19 nt, Artificial Sequence
  source: /note="Description of Artificial Sequence: Synthetic oligonucleotide"
acugauucacauaauacaa

SEQ ID NO: 659 - RNA, 19 nt, Artificial Sequence
  source: /note="Description of Artificial Sequence: Synthetic oligonucleotide"
acuaacaucucacugauuc

SEQ ID NO: 660 - RNA, 19 nt, Artificial Sequence
  source: /note="Description of Artificial Sequence: Synthetic oligonucleotide"
aggcuuauucuacuaacau

SEQ ID NO: 661 - RNA, 19 nt, Artificial Sequence
  source: /note="Description of Artificial Sequence: Synthetic oligonucleotide"
uuuuuuuuuuaaggcuuau

SEQ ID NO: 662 - RNA, 19 nt, Artificial Sequence
  source: /note="Description of Artificial Sequence: Synthetic oligonucleotide"
aaccgauuuuuuuuuuuuu

SEQ ID NO: 663 - RNA, 19 nt, Artificial Sequence
  source: /note="Description of Artificial Sequence: Synthetic oligonucleotide"
ucacugcacccaaccgauu

SEQ ID NO: 664 - RNA, 19 nt, Artificial Sequence
  source: /note="Description of Artificial Sequence: Synthetic oligonucleotide"
acagccgugugccacugca

SEQ ID NO: 665 - RNA, 19 nt, Artificial Sequence
  source: /note="Description of Artificial Sequence: Synthetic oligonucleotide"
aagugcugggauuacagcc

SEQ ID NO: 666 - RNA, 19 nt, Artificial Sequence
  source: /note="Description of Artificial Sequence: Synthetic oligonucleotide"
uuggccucccaaagugcug

SEQ ID NO: 667 - RNA, 19 nt, Artificial Sequence
  source: /note="Description of Artificial Sequence: Synthetic oligonucleotide"
aucugccaaccuuggccuc

SEQ ID NO: 668 - RNA, 19 nt, Artificial Sequence
  source: /note="Description of Artificial Sequence: Synthetic oligonucleotide"
accucaggugaucugccaa

SEQ ID NO: 669 - RNA, 19 nt, Artificial Sequence
  source: /note="Description of Artificial Sequence: Synthetic oligonucleotide"
uuugaacuccugaccucag

SEQ ID NO: 670 - RNA, 19 nt, Artificial Sequence
  source: /note="Description of Artificial Sequence: Synthetic oligonucleotide"
ucagacuggucuugaacuc

SEQ ID NO: 671 - RNA, 19 nt, Artificial Sequence
  source: /note="Description of Artificial Sequence: Synthetic oligonucleotide"
ugcuauguuggccagacug

SEQ ID NO: 672 - RNA, 19 nt, Artificial Sequence
  source: /note="Description of Artificial Sequence: Synthetic oligonucleotide"
uacaggguuuugcuauguu

SEQ ID NO: 673 - RNA, 19 nt, Artificial Sequence
  source: /note="Description of Artificial Sequence: Synthetic oligonucleotide"
auuuuuaguagagacaggg

SEQ ID NO: 674 - RNA, 19 nt, Artificial Sequence
  source: /note="Description of Artificial Sequence: Synthetic oligonucleotide"
auaauuuuuguauuuuuag

SEQ ID NO: 675 - RNA, 19 nt, Artificial Sequence
  source: /note="Description of Artificial Sequence: Synthetic oligonucleotide"
accaugcccagauaauuuu

SEQ ID NO: 676 - RNA, 19 nt, Artificial Sequence
  source: /note="Description of Artificial Sequence: Synthetic oligonucleotide"
aggcaugcaccaccaugcc

SEQ ID NO: 677 - RNA, 19 nt, Artificial Sequence
  source: /note="Description of Artificial Sequence: Synthetic oligonucleotide"
agcugggauuacaggcaug

SEQ ID NO: 678 - RNA, 19 nt, Artificial Sequence
  source: /note="Description of Artificial Sequence: Synthetic oligonucleotide"
uuuccgaauagcugggauu

SEQ ID NO: 679 - RNA, 19 nt, Artificial Sequence
  source: /note="Description of Artificial Sequence: Synthetic oligonucleotide"
ucugccucagccuuccgaa

SEQ ID NO: 680 - RNA, 19 nt, Artificial Sequence
  source: /note="Description of Artificial Sequence: Synthetic oligonucleotide"
ucaagugauucuccugccu

SEQ ID NO: 681 - RNA, 19 nt, Artificial Sequence
  source: /note="Description of Artificial Sequence: Synthetic oligonucleotide"
ucuccuggguucaagugau

SEQ ID NO: 682 - RNA, 19 nt, Artificial Sequence
  source: /note="Description of Artificial Sequence: Synthetic oligonucleotide"
ucgcaaccuccgccuccug

SEQ ID NO: 683 - RNA, 19 nt, Artificial Sequence
  source: /note="Description of Artificial Sequence: Synthetic oligonucleotide"
aaucucagcucaccgcaac

SEQ ID NO: 684 - RNA, 19 nt, Artificial Sequence
  source: /note="Description of Artificial Sequence: Synthetic oligonucleotide"
ugaaauggugcaaucucag

SEQ ID NO: 685 - RNA, 19 nt, Artificial Sequence
  source: /note="Description of Artificial Sequence: Synthetic oligonucleotide"
aggcuggaaugaaauggug

SEQ ID NO: 686 - RNA, 19 nt, Artificial Sequence
  source: /note="Description of Artificial Sequence: Synthetic oligonucleotide"
acucauguugcccaggcug

SEQ ID NO: 687 - RNA, 19 nt, Artificial Sequence
  source: /note="Description of Artificial Sequence: Synthetic oligonucleotide"
ucagacuuucacucauguu

SEQ ID NO: 688 - RNA, 19 nt, Artificial Sequence
  source: /note="Description of Artificial Sequence: Synthetic oligonucleotide"
uuuuuuuuugagucagacu

SEQ ID NO: 689 - RNA, 19 nt, Artificial Sequence
  source: /note="Description of Artificial Sequence: Synthetic oligonucleotide"
uuuuaaauuuuuuuuuuuu

SEQ ID NO: 690 - RNA, 19 nt, Artificial Sequence
  source: /note="Description of Artificial Sequence: Synthetic oligonucleotide"
uauuauuuuguuuuuuaaa

SEQ ID NO: 691 - RNA, 19 nt, Artificial Sequence
  source: /note="Description of Artificial Sequence: Synthetic oligonucleotide"
uugcacacuagauuauuuu

SEQ ID NO: 692 - RNA, 19 nt, Artificial Sequence
  source: /note="Description of Artificial Sequence: Synthetic oligonucleotide"
aggugaaugcccugcacac

SEQ ID NO: 693 - RNA, 19 nt, Artificial Sequence
  source: /note="Description of Artificial Sequence: Synthetic oligonucleotide"
uggggggcugaggugaaug

SEQ ID NO: 694 - RNA, 19 nt, Artificial Sequence
  source: /note="Description of Artificial Sequence: Synthetic oligonucleotide"
uuuggcuccugccuggggg

SEQ ID NO: 695 - RNA, 19 nt, Artificial Sequence
  source: /note="Description of Artificial Sequence: Synthetic oligonucleotide"
ucugcugugcuuggcuccu

SEQ ID NO: 696 - RNA, 19 nt, Artificial Sequence
  source: /note="Description of Artificial Sequence: Synthetic oligonucleotide"
aggcggaagcuccugcugu

SEQ ID NO: 697 - RNA, 19 nt, Artificial Sequence
  source: /note="Description of Artificial Sequence: Synthetic oligonucleotide"
uaguggagaggaggcggaa

SEQ ID NO: 698 - RNA, 19 nt, Artificial Sequence
  source: /note="Description of Artificial Sequence: Synthetic oligonucleotide"
aguugugugcuccagugga

SEQ ID NO: 699 - RNA, 19 nt, Artificial Sequence
  source: /note="Description of Artificial Sequence: Synthetic oligonucleotide"
agccagguucaaguugugu

SEQ ID NO: 700 - RNA, 19 nt, Artificial Sequence
  source: /note="Description of Artificial Sequence: Synthetic oligonucleotide"
ucagaaaauaagccagguu

SEQ ID NO: 701 - RNA, 19 nt, Artificial Sequence
  source: /note="Description of Artificial Sequence: Synthetic oligonucleotide"
ugggcuggucccugcagaa

SEQ ID NO: 702 - RNA, 19 nt, Artificial Sequence
  source: /note="Description of Artificial Sequence: Synthetic oligonucleotide"
acugaccauguggggcugg

SEQ ID NO: 703 - RNA, 19 nt, Artificial Sequence
  source: /note="Description of Artificial Sequence: Synthetic oligonucleotide"
ugccacacauggggagaaa

SEQ ID NO: 704 - RNA, 19 nt, Artificial Sequence
  source: /note="Description of Artificial Sequence: Synthetic oligonucleotide"
cuuuauuucuacacucucu

SEQ ID NO: 705 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggggcggggcugacgucatt

SEQ ID NO: 706 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgucgcgcugggaaugcatt

SEQ ID NO: 707 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaaugcccuggccgagaatt

SEQ ID NO: 708 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggccgagacacugaggcatt

SEQ ID NO: 709 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaggcaggguagagagcatt

SEQ ID NO: 710 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agagagcgcuugcgggcgatt

SEQ ID NO: 711 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgggcgccgggcggagcuatt

SEQ ID NO: 712 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcggagcugcugcggaucatt

SEQ ID NO: 713 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcggaucaggacccgagatt

SEQ ID NO: 714 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acccgagccgauucccgautt

SEQ ID NO: 715 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucccgaucccgacccagatt

SEQ ID NO: 716 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acccagauccuaacccgcatt

SEQ ID NO: 717 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaacccgcgcccccgcccatt

SEQ ID NO: 718 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccgccccgccgccgccgcatt

SEQ ID NO: 719 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgccgccauguacgacgcatt

SEQ ID NO: 720 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacgacgcagagcgcggcutt

SEQ ID NO: 721 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgcggcuggagcuuguccutt

SEQ ID NO: 722 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcuuguccuucgcgggcutt

SEQ ID NO: 723 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgcgggcugcggcuuccuatt

SEQ ID NO: 724 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccugggcuucuaccacatt

SEQ ID NO: 725 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuaccacgucggggcgatt

SEQ ID NO: 726 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cggggcgacccgcugccuatt

SEQ ID NO: 727 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccugagcgagcacgccatt

SEQ ID NO: 728 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcacgccccgcaccuccutt

SEQ ID NO: 729 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accuccuccgcgacgcgcatt

SEQ ID NO: 730 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcgacgcgcgcauguuguutt

SEQ ID NO: 731 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguuguucggcgcuucggatt

SEQ ID NO: 732 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucggccggggcguugcatt

SEQ ID NO: 733 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcguugcacugcgucggatt

SEQ ID NO: 734 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcgucggcguccucuccatt

SEQ ID NO: 735 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuccgguaucccgcuggatt

SEQ ID NO: 736 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccgcuggagcagacucutt

SEQ ID NO: 737 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagacucugcagguccucutt

SEQ ID NO: 738 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccucucagaucuugugcatt

SEQ ID NO: 739 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuugugcggaaggccagatt

SEQ ID NO: 740 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaggccaggagucggaacatt

SEQ ID NO: 741 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cggaacauuggcaucuucatt

SEQ ID NO: 742 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcaucuuccauccauccuutt

SEQ ID NO: 743 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccauccuucaacuuaagcatt

SEQ ID NO: 744 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaagcaaguuccuccgaatt

SEQ ID NO: 745 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuccgacagggucucugatt

SEQ ID NO: 746 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucugcaaaugccucccatt

SEQ ID NO: 747 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccucccggccaaugucatt

SEQ ID NO: 748 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauguccaccagcucaucutt

SEQ ID NO: 749 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcucaucuccggcaaaautt

SEQ ID NO: 750 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cggcaaaauaggcaucucutt

SEQ ID NO: 751 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucucucuuaccagagugutt

SEQ ID NO: 752 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accagagugucugaugggatt

SEQ ID NO: 753 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auggggaaaacguucuggutt

SEQ ID NO: 754 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acguucuggugucugacuutt

SEQ ID NO: 755 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugacuuucgguccaaagtt

SEQ ID NO: 756 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccaaagacgaagucgugatt

SEQ ID NO: 757 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagucguggaugccuuggutt

SEQ ID NO: 758 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuugguauguuccugcuutt

SEQ ID NO: 759 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccugcuucauccccuucutt

SEQ ID NO: 760 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccccuucuacaguggccutt

SEQ ID NO: 761 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguggccuuaucccuccuutt

SEQ ID NO: 762 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuccuuccuucagaggcatt

SEQ ID NO: 763 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagaggcgugcgauaugutt

SEQ ID NO: 764 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gauauguggauggaggagutt

SEQ ID NO: 765 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaggagugagugacaacgutt

SEQ ID NO: 766 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugacaacguacccuucauutt

SEQ ID NO: 767 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuucauugaugccaaaactt

SEQ ID NO: 768 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccaaaacaaccaucacatt

SEQ ID NO: 769 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucaccgugucccccuucutt

SEQ ID NO: 770 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccccuucuauggggagutt

SEQ ID NO: 771 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggggaguacgacaucugatt

SEQ ID NO: 772 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucugcccuaaagucaagutt

SEQ ID NO: 773 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agucaaguccacgaacuuutt

SEQ ID NO: 774 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgaacuuucuucaugugatt

SEQ ID NO: 775 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucauguggacaucaccaatt

SEQ ID NO: 776 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaccaagcucagucuacatt

SEQ ID NO: 777 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agucuacgccucugcacaatt

SEQ ID NO: 778 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcacagggaaccucuaatt

SEQ ID NO: 779 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaccucuaccuucucucgatt

SEQ ID NO: 780 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucgagagcuuuuguccatt

SEQ ID NO: 781 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuguccccccggaucucatt

SEQ ID NO: 782 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccggaucucaaggugcugatt

SEQ ID NO: 783 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcugggagagauaugccutt

SEQ ID NO: 784 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agauaugccuucgaggauatt

SEQ ID NO: 785 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggauauuuggaugcauuatt

SEQ ID NO: 786 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augcauucagguucuuggatt

SEQ ID NO: 787 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuuggaagagaagggcatt

SEQ ID NO: 788 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagaagggcaucugcaacatt

SEQ ID NO: 789 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcaacaggccccagccaatt

SEQ ID NO: 790 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagccaggccugaagucautt

SEQ ID NO: 791 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaagucauccucagaaggatt

SEQ ID NO: 792 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagaagggauggauccuatt

SEQ ID NO: 793 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggauccugaggucgccautt

SEQ ID NO: 794 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgccaugcccagcugggcatt

SEQ ID NO: 795 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagcugggcaaacaugagutt

SEQ ID NO: 796 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caugagucuggauucuucatt

SEQ ID NO: 797 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuuccccggagucggcutt

SEQ ID NO: 798 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agucggcugccuuggcugutt

SEQ ID NO: 799 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggcugugaggcuggagatt

SEQ ID NO: 800 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcuggagggagaugagatt

SEQ ID NO: 801 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augagcugcuagaccaccutt

SEQ ID NO: 802 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagaccaccugcgucucaatt

SEQ ID NO: 803 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgucucagcauccugcccutt

SEQ ID NO: 804 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccugcccugggaugagagatt

SEQ ID NO: 805 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augagagcauccuggacaatt

SEQ ID NO: 806 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggacacccucucgcccaatt

SEQ ID NO: 807 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgcccaggcucgcuacaatt

SEQ ID NO: 808 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgcuacagcacugagugatt

SEQ ID NO: 809 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugagugaagaaaugaaagtt

SEQ ID NO: 810 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augaaagacaaagguggautt

SEQ ID NO: 811 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagguggauacaugagcaatt

SEQ ID NO: 812 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augagcaagauuugcaacutt

SEQ ID NO: 813 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugcaacuugcuacccauutt

SEQ ID NO: 814 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acccauuaggauaaugucutt

SEQ ID NO: 815 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaugucuuauguaaugcutt

SEQ ID NO: 816 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaugcugcccuguacccutt

SEQ ID NO: 817 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguacccugccuguggaautt

SEQ ID NO: 818 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguggaaucugccauugcatt

SEQ ID NO: 819 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccauugcgauuguccaatt

SEQ ID NO: 820 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuguccagagacuggugaatt

SEQ ID NO: 821 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggugacauggcuuccagautt

SEQ ID NO: 822 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccagauaugcccgacgatt

SEQ ID NO: 823 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcccgacgauguccuguatt

SEQ ID NO: 824 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccugugguugcagugggutt

SEQ ID NO: 825 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agugggugaccucacaggutt

SEQ ID NO: 826 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacagguguucacucgaatt

SEQ ID NO: 827 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucacucgagugcugaugutt

SEQ ID NO: 828 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaugugucugcuccccgatt

SEQ ID NO: 829 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuccccgccuccagguatt

SEQ ID NO: 830 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccaggucccaaaugccagutt

SEQ ID NO: 831 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaugccagugagcagccaatt

SEQ ID NO: 832 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agccaacaggccuccccautt

SEQ ID NO: 833 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuccccaugcacaccugatt

SEQ ID NO: 834 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caccugagcaggacuggcatt

SEQ ID NO: 835 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacuggcccugcuggacuatt

SEQ ID NO: 836 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuggacucccugcuccatt

SEQ ID NO: 837 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugcucccccaagggcugutt

SEQ ID NO: 838 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggcuguccagcagagaatt

SEQ ID NO: 839 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagagaccaaagcagaggatt

SEQ ID NO: 840 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcagaggccaccccgcgatt

SEQ ID NO: 841 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccgcgguccauccucaggutt

SEQ ID NO: 842 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccucagguccagccugaaatt

SEQ ID NO: 843 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agccugaacuucuucuugatt

SEQ ID NO: 844 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuugggcaauaaaguaatt

SEQ ID NO: 845 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaaguaccugcuggugcutt

SEQ ID NO: 846 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuggugcugaggggcucuatt

SEQ ID NO: 847 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggggcucuccaccuuucatt

SEQ ID NO: 848 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuuucccaguuuuucacutt

SEQ ID NO: 849 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuucacuagagaagagutt

SEQ ID NO: 850 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagagucugugagucacuutt

SEQ ID NO: 851 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agucacuugaggaggcgaatt

SEQ ID NO: 852 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggaggcgagucuagcagatt

SEQ ID NO: 853 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcagauucuuucagaggutt

SEQ ID NO: 854 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucagaggugcuaaaguuutt

SEQ ID NO: 855 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaaguuucccaucuuugutt

SEQ ID NO: 856 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuuugugcagcuaccucatt

SEQ ID NO: 857 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcuaccuccgcauugcuatt

SEQ ID NO: 858 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugcuguguagugaccccutt

SEQ ID NO: 859 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaccccugccugugacgutt

SEQ ID NO: 860 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugacguggaggaucccatt

SEQ ID NO: 861 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggaucccagccucugagatt

SEQ ID NO: 862 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucugagcugaguugguuutt

SEQ ID NO: 863 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugguuuuaugaaaagcuatt

SEQ ID NO: 864 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaagcuaggaagcaaccutt

SEQ ID NO: 865 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaagcaaccuuucgccugutt

SEQ ID NO: 866 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgccugugcagcgguccatt

SEQ ID NO: 867 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgguccagcacuuaacucutt

SEQ ID NO: 868 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaacucuaauacaucagatt

SEQ ID NO: 869 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacaucagcaugcguuaautt

SEQ ID NO: 870 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cguuaauucagcugguugatt

SEQ ID NO: 871 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugguugggaaaugacacatt

SEQ ID NO: 872 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaugacaccaggaagcccatt

SEQ ID NO: 873 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagcccagugcagaggguatt

SEQ ID NO: 874 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agagggucccuuacugacutt

SEQ ID NO: 875 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuacugacuguuucguggatt

SEQ ID NO: 876 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucguggcccuauuaaugatt

SEQ ID NO: 877 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaauggucagacuguucatt

SEQ ID NO: 878 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gacuguuccagcaugaggutt

SEQ ID NO: 879 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugagguucuuagaaugacatt

SEQ ID NO: 880 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagaaugacagguguuugatt

SEQ ID NO: 881 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguuuggaugggugggggatt

SEQ ID NO: 882 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugggggccuugugaugggatt

SEQ ID NO: 883 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugaugggggguaggcuatt

SEQ ID NO: 884 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaggcuggcccaugugugatt

SEQ ID NO: 885 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugugaucuugugggguatt

SEQ ID NO: 886 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugugggguggagggaagatt

SEQ ID NO: 887 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggaagagaauagcaugatt

SEQ ID NO: 888 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagcaugaucccacuuccatt

SEQ ID NO: 889 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuuccccaugcugugggatt

SEQ ID NO: 890 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugugggaaggggugcagutt

SEQ ID NO: 891 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugcaguucguccccaagatt

SEQ ID NO: 892 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccccaagaacgacacugatt

SEQ ID NO: 893 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acacugccugucagguggutt

SEQ ID NO: 894 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagguggucugcaaagautt

SEQ ID NO: 895 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcaaagaugauaaccuuatt

SEQ ID NO: 896 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaccuugacuacuaaaaactt

SEQ ID NO: 897 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaaaacgucuccauggcatt

SEQ ID NO: 898 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccauggcggggguaacaaatt

SEQ ID NO: 899 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gguaacaagaugauaaucutt

SEQ ID NO: 900 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugauaaucuacuuaauuuutt

SEQ ID NO: 901 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuaauuuuagaacaccuuutt

SEQ ID NO: 902 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaccuuuuucaccuaacutt

SEQ ID NO: 903 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuaacuaaaauaauguuutt

SEQ ID NO: 904 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auaauguuuaaagaguuuutt

SEQ ID NO: 905 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaguuuuguauaaaaaugutt

SEQ ID NO: 906 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaaauguaaggaagcguutt

SEQ ID NO: 907 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaagcguuguuaccuguutt

SEQ ID NO: 908 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaccuguugaauuuuguautt

SEQ ID NO: 909 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuguauuaugugaaucagutt

SEQ ID NO: 910 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaucagugagauguuagutt

SEQ ID NO: 911 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auguuaguagaauaagccutt

SEQ ID NO: 912 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auaagccuuaaaaaaaaaatt

SEQ ID NO: 913 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaaaaaaaaaaaucgguutt

SEQ ID NO: 914 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaucgguugggugcagugatt

SEQ ID NO: 915 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcaguggcacacggcugutt

SEQ ID NO: 916 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcuguaaucccagcacuutt

SEQ ID NO: 917 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagcacuuugggaggccaatt

SEQ ID NO: 918 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaggccaagguuggcagautt

SEQ ID NO: 919 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggcagaucaccugaggutt

SEQ ID NO: 920 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugaggucaggaguucaaatt

SEQ ID NO: 921 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaguucaagaccagucugatt

SEQ ID NO: 922 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagucuggccaacauagcatt

SEQ ID NO: 923 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacauagcaaaacccuguatt

SEQ ID NO: 924 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccugucucuacuaaaaautt

SEQ ID NO: 925 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuaaaaauacaaaaauuautt

SEQ ID NO: 926 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaauuaucugggcauggutt

SEQ ID NO: 927 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggcaugguggugcaugccutt

SEQ ID NO: 928 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caugccuguaaucccagcutt

SEQ ID NO: 929 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaucccagcuauucggaaatt

SEQ ID NO: 930 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucggaaggcugaggcagatt

SEQ ID NO: 931 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcaggagaaucacuugatt

SEQ ID NO: 932 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucacuugaacccaggagatt

SEQ ID NO: 933 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caggaggcggagguugcgatt

SEQ ID NO: 934 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guugcggugagcugagauutt

SEQ ID NO: 935 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugagauugcaccauuucatt

SEQ ID NO: 936 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
caccauuucauuccagccutt

SEQ ID NO: 937 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagccugggcaacaugagutt

SEQ ID NO: 938 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacaugagugaaagucugatt

SEQ ID NO: 939 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agucugacucaaaaaaaaatt

SEQ ID NO: 940 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaaaaaaaaaauuuaaaatt

SEQ ID NO: 941 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuaaaaaacaaaauaauatt

SEQ ID NO: 942 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaauaaucuagugugcaatt

SEQ ID NO: 943 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugugcagggcauucaccutt

SEQ ID NO: 944 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cauucaccucagccccccatt

SEQ ID NO: 945 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cccccaggcaggagccaaatt

SEQ ID NO: 946 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggagccaagcacagcagatt

SEQ ID NO: 947 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acagcaggagcuuccgccutt

SEQ ID NO: 948 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccgccuccucuccacuatt

SEQ ID NO: 949 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccacuggagcacacaacutt

SEQ ID NO: 950 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acacaacuugaaccuggcutt

SEQ ID NO: 951 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaccuggcuuauuuucugatt

SEQ ID NO: 952 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucugcagggaccagcccatt

SEQ ID NO: 953 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccagccccacauggucagutt

SEQ ID NO: 954 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuucuccccauguguggcatt

SEQ ID NO: 955 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agagaguguagaaauaaagtt

SEQ ID NO: 956 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugacgucagccccgccccctt

SEQ ID NO: 957 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcauucccagcgcgacgutt

SEQ ID NO: 958 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucucggccagggcauucctt

SEQ ID NO: 959 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccucagugucucggccatt

SEQ ID NO: 960 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcucucuacccugccucatt

SEQ ID NO: 961 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgcccgcaagcgcucucutt

SEQ ID NO: 962 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagcuccgcccggcgcccgtt

SEQ ID NO: 963 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugauccgcagcagcuccgctt

SEQ ID NO: 964 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucggguccugauccgcatt

SEQ ID NO: 965 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucgggaaucggcucgggutt

SEQ ID NO: 966 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugggucgggaucgggaatt

SEQ ID NO: 967 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcggguuaggaucugggutt

SEQ ID NO: 968 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugggcgggggcgcggguuatt

SEQ ID NO: 969 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcggcggcggcggggcggtt

SEQ ID NO: 970 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcgucguacauggcggcgtt

SEQ ID NO: 971 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agccgcgcucugcgucguatt

SEQ ID NO: 972 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggacaagcuccagccgcgtt

SEQ ID NO: 973 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcccgcgaaggacaagcutt

SEQ ID NO: 974 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaggaagccgcagcccgcgtt

SEQ ID NO: 975 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugguagaagcccaggaatt

SEQ ID NO: 976 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgccccgacgugguagaatt

SEQ ID NO: 977 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaggcagcgggucgccccgtt

SEQ ID NO: 978 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggcgugcucgcucaggcatt

SEQ ID NO: 979 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggaggugcggggcgugcutt

SEQ ID NO: 980 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcgcgucgcggaggaggutt

SEQ ID NO: 981 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacaacaugcgcgcgucgctt

SEQ ID NO: 982 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccgaagcgccgaacaacatt

SEQ ID NO: 983 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcaacgccccggccgaagtt

SEQ ID NO: 984 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccgacgcagugcaacgcctt

SEQ ID NO: 985 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggagaggacgccgacgcatt

SEQ ID NO: 986 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccagcgggauaccggagatt

SEQ ID NO: 987 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agagucugcuccagcgggatt

SEQ ID NO: 988 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaggaccugcagagucugtt

SEQ ID NO: 989 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcacaagaucugagaggatt

SEQ ID NO: 990 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuggccuuccgcacaagatt

SEQ ID NO: 991 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguuccgacuccuggccuutt

SEQ ID NO: 992 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaagaugccaauguuccgtt

SEQ ID NO: 993 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaggauggauggaagaugctt

SEQ ID NO: 994 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuuaaguugaaggauggtt

SEQ ID NO: 995 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucggaggaacuugcuuaatt

SEQ ID NO: 996 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagagacccugucggaggtt

SEQ ID NO: 997 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugggaggcauuugcagagatt

SEQ ID NO: 998 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugacauuggccgggaggcatt

SEQ ID NO: 999 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaugagcugguggacauutt

SEQ ID NO: 1000 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuuugccggagaugagcutt

SEQ ID NO: 1001 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agagaugccuauuuugccgtt

SEQ ID NO: 1002 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acacucugguaagagagautt

SEQ ID NO: 1003 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccaucagacacucuggutt

SEQ ID NO: 1004 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accagaacguuuuccccautt

SEQ ID NO: 1005 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagucagacaccagaacgutt

SEQ ID NO: 1006 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuuggaccgaaagucagatt

SEQ ID NO: 1007 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacgacuucgucuuuggatt

SEQ ID NO: 1008 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accaaggcauccacgacuutt

SEQ ID NO: 1009 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagcaggaacauaccaaggtt

SEQ ID NO: 1010 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaaggggaugaagcaggatt

SEQ ID NO: 1011 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggccacuguagaaggggatt

SEQ ID NO: 1012 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaggagggauaaggccacutt

SEQ ID NO: 1013 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccucugaaggaaggaggtt

SEQ ID NO: 1014 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acauaucgcacgccucugatt

SEQ ID NO: 1015 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuccuccauccacauauctt

SEQ ID NO: 1016 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acguugucacucacuccuctt

SEQ ID NO: 1017 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaugaaggguacguugucatt

SEQ ID NO: 1018 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuuuggcaucaaugaaggtt

SEQ ID NO: 1019 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugaugguuguuuuggcatt

SEQ ID NO: 1020 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaagggggacacggugautt

SEQ ID NO: 1021 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuccccauagaagggggatt

SEQ ID NO: 1022 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagaugucguacuccccatt

SEQ ID NO: 1023 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuugacuuuagggcagautt

SEQ ID NO: 1024 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaguucguggacuugacutt

SEQ ID NO: 1025 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacaugaagaaaguucgutt

SEQ ID NO: 1026 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggugauguccacaugaatt

SEQ ID NO: 1027 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguagacugagcuuggugatt

SEQ ID NO: 1028 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugugcagaggcguagacutt

SEQ ID NO: 1029 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuagagguucccugugcagtt

SEQ ID NO: 1030 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgagagaagguagagguutt

SEQ ID NO: 1031 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggacaaaagcucucgagatt

SEQ ID NO: 1032 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugagauccggggggacaaatt

SEQ ID NO: 1033 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagcaccuugagauccggtt

SEQ ID NO: 1034 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcauaucucucccagcatt

SEQ ID NO: 1035 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauccucgaaggcauaucutt

SEQ ID NO: 1036 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaugcauccaaauauccutt

SEQ ID NO: 1037 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccaagaaccugaaugcautt

SEQ ID NO: 1038 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcccuucucuuccaagaatt

SEQ ID NO: 1039 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguugcagaugcccuucuctt

SEQ ID NO: 1040 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggcuggggccuguugcatt

SEQ ID NO: 1041 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augacuucaggccuggcugtt

SEQ ID NO: 1042 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccuucugaggaugacuuctt

SEQ ID NO: 1043 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaggauccaucccuucugatt

SEQ ID NO: 1044 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auggcgaccucaggauccatt

SEQ ID NO: 1045 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcccagcugggcauggcgtt

SEQ ID NO: 1046 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucauguuugcccagcugtt

SEQ ID NO: 1047 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaagaauccagacucaugtt

SEQ ID NO: 1048 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agccgacuccggggaagaatt

SEQ ID NO: 1049 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acagccaaggcagccgacutt

SEQ ID NO: 1050 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuccagccucacagccaatt

SEQ ID NO: 1051 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucaucucccuccagccutt

SEQ ID NO: 1052 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agguggucuagcagcucautt

SEQ ID NO: 1053 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugagacgcagguggucuatt

SEQ ID NO: 1054 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggcaggaugcugagacgtt

SEQ ID NO: 1055 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucucaucccagggcaggtt

SEQ ID NO: 1056 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuguccaggaugcucucautt

SEQ ID NO: 1057 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugggcgagaggguguccatt

SEQ ID NO: 1058 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuguagcgagccugggcgatt

SEQ ID NO: 1059 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacucagugcuguagcgatt

SEQ ID NO: 1060 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuucauuucuucacucagtt

SEQ ID NO: 1061 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auccaccuuugucuuucautt

SEQ ID NO: 1062 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugcucauguauccaccuutt

SEQ ID NO: 1063 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguugcaaaucuugcucautt

SEQ ID NO: 1064 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauggguagcaaguugcaatt

SEQ ID NO: 1065 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agacauuauccuaaugggutt

SEQ ID NO: 1066 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcauuacauaagacauuatt

SEQ ID NO: 1067 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggguacagggcagcauuatt

SEQ ID NO: 1068 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuccacaggcaggguacatt

SEQ ID NO: 1069 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcaauggcagauuccacatt

SEQ ID NO: 1070 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggacaaucgcaauggcatt

SEQ ID NO: 1071 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucaccagucucuggacaatt

SEQ ID NO: 1072 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucuggaagccaugucacctt

SEQ ID NO: 1073 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgucgggcauaucuggaatt

SEQ ID NO: 1074 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacaggacaucgucgggcatt

SEQ ID NO: 1075 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acccacugcaaccacaggatt

SEQ ID NO: 1076 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accugugaggucacccacutt

SEQ ID NO: 1077 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucgagugaacaccugugatt

SEQ ID NO: 1078 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaucagcacucgagugaatt

SEQ ID NO: 1079 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucggggagcagacacaucatt

SEQ ID NO: 1080 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaccuggaggcggggagcatt

SEQ ID NO: 1081 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuggcauuugggaccuggtt

SEQ ID NO: 1082 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggcugcucacuggcauutt

SEQ ID NO: 1083 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auggggaggccuguuggcutt

SEQ ID NO: 1084 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaggugugcauggggaggtt

SEQ ID NO: 1085 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccaguccugcucaggugtt

SEQ ID NO: 1086 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaguccagcagggccaguctt

SEQ ID NO: 1087 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggagcagggaguccagcatt

SEQ ID NO: 1088 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acagcccuugggggagcagtt

SEQ ID NO: 1089 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucucugcuggacagcccutt

SEQ ID NO: 1090 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccucugcuuuggucucugtt

SEQ ID NO: 1091 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgcgggguggccucugcutt

SEQ ID NO: 1092 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accugaggauggaccgcggtt

SEQ ID NO: 1093 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuucaggcuggaccugaggtt

SEQ ID NO: 1094 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaagaagaaguucaggcutt

SEQ ID NO: 1095 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuacuuuauugcccaagaatt

SEQ ID NO: 1096 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcaccagcagguacuuuatt

SEQ ID NO: 1097 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagagccccucagcaccagtt

SEQ ID NO: 1098 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaaagguggagagccccutt

SEQ ID NO: 1099 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agugaaaaacugggaaaggtt

SEQ ID NO: 1100 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucuucucuagugaaaaatt

SEQ ID NO: 1101 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagugacucacagacucuutt

SEQ ID NO: 1102 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucgccuccucaagugacutt

SEQ ID NO: 1103 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugcuagacucgccuccutt

SEQ ID NO: 1104 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accucugaaagaaucugcutt

SEQ ID NO: 1105 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaacuuuagcaccucugaatt

SEQ ID NO: 1106 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaaagaugggaaacuuuatt

SEQ ID NO: 1107 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugagguagcugcacaaagatt

SEQ ID NO: 1108 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagcaaugcggagguagcutt

SEQ ID NO: 1109 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggggucacuacacagcaatt

SEQ ID NO: 1110 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgucacaggcaggggucatt

SEQ ID NO: 1111 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugggauccuccacgucacatt

SEQ ID NO: 1112 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucagaggcugggauccutt

SEQ ID NO: 1113 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaccaacucagcucagagtt

SEQ ID NO: 1114 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagcuuuucauaaaaccaatt

SEQ ID NO: 1115 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agguugcuuccuagcuuuutt

SEQ ID NO: 1116 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acaggcgaaagguugcuuctt

SEQ ID NO: 1117 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggaccgcugcacaggcgatt

SEQ ID NO: 1118 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaguuaagugcuggaccgtt

SEQ ID NO: 1119 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugauguauuagaguuaatt

SEQ ID NO: 1120 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuaacgcaugcugauguatt

SEQ ID NO: 1121 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaaccagcugaauuaacgtt

SEQ ID NO: 1122 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugucauuucccaaccagtt

SEQ ID NO: 1123 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugggcuuccuggugucauutt

SEQ ID NO: 1124 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacccucugcacugggcuutt

SEQ ID NO: 1125 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agucaguaagggacccucutt

SEQ ID NO: 1126 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccacgaaacagucaguaatt

SEQ ID NO: 1127 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucauuaauagggccacgaatt

SEQ ID NO: 1128 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaacagucugaccauuaatt

SEQ ID NO: 1129 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accucaugcuggaacaguctt

SEQ ID NO: 1130 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucauucuaagaaccucatt

SEQ ID NO: 1131 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaaacaccugucauucuatt

SEQ ID NO: 1132 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccccacccauccaaacatt

SEQ ID NO: 1133 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccaucacaaggcccccatt

SEQ ID NO: 1134 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagccuaccccccaucacatt

SEQ ID NO: 1135 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacacaugggccagccuatt

SEQ ID NO: 1136 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaccccacaagaucacacatt

SEQ ID NO: 1137 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuucccuccaccccacaatt

SEQ ID NO: 1138 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaugcuauucucuucccutt

SEQ ID NO: 1139 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggaagugggaucaugcuatt

SEQ ID NO: 1140 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucccacagcauggggaagutt

SEQ ID NO: 1141 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acugcaccccuucccacagtt

SEQ ID NO: 1142 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuuggggacgaacugcactt

SEQ ID NO: 1143 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagugucguucuuggggatt

SEQ ID NO: 1144 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accaccugacaggcagugutt

SEQ ID NO: 1145 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucuuugcagaccaccugatt

SEQ ID NO: 1146 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaagguuaucaucuuugcatt

SEQ ID NO: 1147 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
guuuuuaguagucaagguutt

SEQ ID NO: 1148 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccauggagacguuuuuatt

SEQ ID NO: 1149 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuguuacccccgccauggtt

SEQ ID NO: 1150 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agauuaucaucuuguuacctt

SEQ ID NO: 1151 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaauuaaguagauuaucatt

SEQ ID NO: 1152 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaagguguucuaaaauuaatt

SEQ ID NO: 1153 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguuaggugaaaaaggugutt

SEQ ID NO: 1154 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaacauuauuuuaguuaggtt

SEQ ID NO: 1155 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaacucuuuaaacauuautt

SEQ ID NO: 1156 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acauuuuuauacaaaacuctt

SEQ ID NO: 1157 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacgcuuccuuacauuuuutt

SEQ ID NO: 1158 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aacagguaacaacgcuucctt

SEQ ID NO: 1159 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auacaaaauucaacagguatt

SEQ ID NO: 1160 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acugauucacauaauacaatt

SEQ ID NO: 1161 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acuaacaucucacugauuctt

SEQ ID NO: 1162 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcuuauucuacuaacautt

SEQ ID NO: 1163 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuuuuuuuaaggcuuautt

SEQ ID NO: 1164 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaccgauuuuuuuuuuuuutt

SEQ ID NO: 1165 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucacugcacccaaccgauutt

SEQ ID NO: 1166 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acagccgugugccacugcatt

SEQ ID NO: 1167 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagugcugggauuacagcctt

SEQ ID NO: 1168 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggccucccaaagugcugtt

SEQ ID NO: 1169 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucugccaaccuuggccuctt

SEQ ID NO: 1170 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accucaggugaucugccaatt

SEQ ID NO: 1171 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuugaacuccugaccucagtt

SEQ ID NO: 1172 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagacuggucuugaacuctt

SEQ ID NO: 1173 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuauguuggccagacugtt

SEQ ID NO: 1174 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uacaggguuuugcuauguutt

SEQ ID NO: 1175 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuuuuaguagagacagggtt

SEQ ID NO: 1176 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auaauuuuuguauuuuuagtt

SEQ ID NO: 1177 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accaugcccagauaauuuutt

SEQ ID NO: 1178 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcaugcaccaccaugcctt

SEQ ID NO: 1179 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agcugggauuacaggcaugtt

SEQ ID NO: 1180 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuccgaauagcugggauutt

SEQ ID NO: 1181 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugccucagccuuccgaatt

SEQ ID NO: 1182 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucaagugauucuccugccutt

SEQ ID NO: 1183 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuccuggguucaagugautt

SEQ ID NO: 1184 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgcaaccuccgccuccugtt

SEQ ID NO: 1185 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaucucagcucaccgcaactt

SEQ ID NO: 1186 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaaauggugcaaucucagtt

SEQ ID NO: 1187 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcuggaaugaaauggugtt

SEQ ID NO: 1188 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucauguugcccaggcugtt

SEQ ID NO: 1189 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagacuuucacucauguutt

SEQ ID NO: 1190 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuuuuuugagucagacutt

SEQ ID NO: 1191 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuuaaauuuuuuuuuuuutt

SEQ ID NO: 1192 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauuauuuuguuuuuuaaatt

SEQ ID NO: 1193 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugcacacuagauuauuuutt

SEQ ID NO: 1194 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggugaaugcccugcacactt

SEQ ID NO: 1195 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uggggggcugaggugaaugtt

SEQ ID NO: 1196 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuuggcuccugccugggggtt

SEQ ID NO: 1197 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucugcugugcuuggcuccutt

SEQ ID NO: 1198 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggcggaagcuccugcugutt

SEQ ID NO: 1199 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaguggagaggaggcggaatt

SEQ ID NO: 1200 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguugugugcuccaguggatt

SEQ ID NO: 1201 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agccagguucaaguugugutt

SEQ ID NO: 1202 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucagaaaauaagccagguutt

SEQ ID NO: 1203 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugggcuggucccugcagaatt

SEQ ID NO: 1204 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acugaccauguggggcuggtt

SEQ ID NO: 1205 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugccacacauggggagaaatt

SEQ ID NO: 1206 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuuauuucuacacucucutt

SEQ ID NO: 1207 - RNA, 18 nt, Artificial Sequence
  source: /note="Description of Artificial Sequence: Synthetic oligonucleotide"
agcggggucugaagucau

SEQ ID NO: 1208 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuacgcugaguacuucgatt

SEQ ID NO: 1209 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgaaguacucagcguaagtt

SEQ ID NO: 1210 - RNA, 21 nt, Artificial Sequence
  source: /note="Description of Artificial Sequence: Synthetic oligonucleotide"
ggcuuccugggcuucuaccaa

SEQ ID NO: 1211 - RNA, 21 nt, Artificial Sequence
  source: /note="Description of Artificial Sequence: Synthetic oligonucleotide"
uugugcggaaggccaggagua

SEQ ID NO: 1212 - RNA, 21 nt, Artificial Sequence
  source: /note="Description of Artificial Sequence: Synthetic oligonucleotide"
aaggccaggagucggaacauu

SEQ ID NO: 1213 - RNA, 21 nt, Artificial Sequence
  source: /note="Description of Artificial Sequence: Synthetic oligonucleotide"
aggccaggagucggaacauua

SEQ ID NO: 1214 - RNA, 21 nt, Artificial Sequence
  source: /note="Description of Artificial Sequence: Synthetic oligonucleotide"
aacguucuggugucugacuuu

SEQ ID NO: 1215 - RNA, 21 nt, Artificial Sequence
  source: /note="Description of Artificial Sequence: Synthetic oligonucleotide"
cugacuuucgguccaaagaca

SEQ ID NO: 1216 - RNA, 21 nt, Artificial Sequence
  source: /note="Description of Artificial Sequence: Synthetic oligonucleotide"
ucgguccaaagacgaagucgu

SEQ ID NO: 1217 - RNA, 21 nt, Artificial Sequence
  source: /note="Description of Artificial Sequence: Synthetic oligonucleotide"
cgguccaaagacgaagucgua

SEQ ID NO: 1218 - RNA, 21 nt, Artificial Sequence
  source: /note="Description of Artificial Sequence: Synthetic oligonucleotide"
gacgaagucguggaugccuua

SEQ ID NO: 1219 - RNA, 21 nt, Artificial Sequence
  source: /note="Description of Artificial Sequence: Synthetic oligonucleotide"
cuugguauguuccugcuucau

SEQ ID NO: 1220 - RNA, 21 nt, Artificial Sequence
  source: /note="Description of Artificial Sequence: Synthetic oligonucleotide"
ggccuuaucccuccuuccuua

SEQ ID NO: 1221 - RNA, 21 nt, Artificial Sequence
  source: /note="Description of Artificial Sequence: Synthetic oligonucleotide"
aggagugagugacaacguaca

SEQ ID NO: 1222 - RNA, 21 nt, Artificial Sequence
  source: /note="Description of Artificial Sequence: Synthetic oligonucleotide"
gugagugacaacguacccuua

SEQ ID NO: 1223 - RNA, 21 nt, Artificial Sequence
  source: /note="Description of Artificial Sequence: Synthetic oligonucleotide"
ugaugccaaaacaaccaucaa

SEQ ID NO: 1224 - RNA, 21 nt, Artificial Sequence
  source: /note="Description of Artificial Sequence: Synthetic oligonucleotide"
cgacaucugcccuaaagucaa

SEQ ID NO: 1225 - RNA, 21 nt, Artificial Sequence
  source: /note="Description of Artificial Sequence: Synthetic oligonucleotide"
acgaacuuucuucauguggaa

SEQ ID NO: 1226 - RNA, 21 nt, Artificial Sequence
  source: /note="Description of Artificial Sequence: Synthetic oligonucleotide"
gcacagggaaccucuaccuua

SEQ ID NO: 1227 - RNA, 21 nt, Artificial Sequence
  source: /note="Description of Artificial Sequence: Synthetic oligonucleotide"
ugcugggagagauaugccuua

SEQ ID NO: 1228 - RNA, 21 nt, Artificial Sequence
  source: /note="Description of Artificial Sequence: Synthetic oligonucleotide"
ugggagagauaugccuucgaa

SEQ ID NO: 1229 - RNA, 21 nt, Artificial Sequence
  source: /note="Description of Artificial Sequence: Synthetic oligonucleotide"
agagauaugccuucgaggaua

SEQ ID NO: 1230 - RNA, 21 nt, Artificial Sequence
  source: /note="Description of Artificial Sequence: Synthetic oligonucleotide"
auaugccuucgaggauauuua

SEQ ID NO: 1231 - RNA, 21 nt, Artificial Sequence
  source: /note="Description of Artificial Sequence: Synthetic oligonucleotide"
ugccuucgaggauauuuggau

SEQ ID NO: 1232 - RNA, 21 nt, Artificial Sequence
  source: /note="Description of Artificial Sequence: Synthetic oligonucleotide"
auucagguucuuggaagagaa

SEQ ID NO: 1233 - RNA, 21 nt, Artificial Sequence
  source: /note="Description of Artificial Sequence: Synthetic oligonucleotide"
cauccucagaagggauggaua

SEQ ID NO: 1234 - RNA, 21 nt, Artificial Sequence
  source: /note="Description of Artificial Sequence: Synthetic oligonucleotide"
ccugcccugggaugagagcau

SEQ ID NO: 1235 - RNA, 21 nt, Artificial Sequence
  source: /note="Description of Artificial Sequence: Synthetic oligonucleotide"
gacaaagguggauacaugaga

SEQ ID NO: 1236 - RNA, 21 nt, Artificial Sequence
  source: /note="Description of Artificial Sequence: Synthetic oligonucleotide"
aaagguggauacaugagcaaa

SEQ ID NO: 1237 - RNA, 21 nt, Artificial Sequence
  source: /note="Description of Artificial Sequence: Synthetic oligonucleotide"
guggauacaugagcaagauuu

SEQ ID NO: 1238 - RNA, 21 nt, Artificial Sequence
  source: /note="Description of Artificial Sequence: Synthetic oligonucleotide"
uggauacaugagcaagauuua

SEQ ID NO: 1239 - RNA, 21 nt, Artificial Sequence
  source: /note="Description of Artificial Sequence: Synthetic oligonucleotide"
auacaugagcaagauuugcaa

SEQ ID NO: 1240 - RNA, 21 nt, Artificial Sequence
  source: /note="Description of Artificial Sequence: Synthetic oligonucleotide"
agcaagauuugcaacuugcua

SEQ ID NO: 1241 - RNA, 21 nt, Artificial Sequence
  source: /note="Description of Artificial Sequence: Synthetic oligonucleotide"
caagauuugcaacuugcuaca

SEQ ID NO: 1242 - RNA, 21 nt, Artificial Sequence
  source: /note="Description of Artificial Sequence: Synthetic oligonucleotide"
ugcaacuugcuacccauuaga

SEQ ID NO: 1243 - RNA, 21 nt, Artificial Sequence
  source: /note="Description of Artificial Sequence: Synthetic oligonucleotide"
aacuugcuacccauuaggaua

SEQ ID NO: 1244 - RNA, 21 nt, Artificial Sequence
  source: /note="Description of Artificial Sequence: Synthetic oligonucleotide"
gccauugcgauuguccagaga

SEQ ID NO: 1245 - RNA, 21 nt, Artificial Sequence
  source: /note="Description of Artificial Sequence: Synthetic oligonucleotide"
gauuguccagagacuggugaa

SEQ ID NO: 1246 - RNA, 21 nt, Artificial Sequence
  source: /note="Description of Artificial Sequence: Synthetic oligonucleotide"
uggugacauggcuuccagaua

SEQ ID NO: 1247 - RNA, 21 nt, Artificial Sequence
  source: /note="Description of Artificial Sequence: Synthetic oligonucleotide"
ccagauaugcccgacgaugua

SEQ ID NO: 1248 - RNA, 21 nt, Artificial Sequence
  source: /note="Description of Artificial Sequence: Synthetic oligonucleotide"
gugguugcagugggugaccua

SEQ ID NO: 1249 - RNA, 21 nt, Artificial Sequence
  source: /note="Description of Artificial Sequence: Synthetic oligonucleotide"
aggucccaaaugccagugaga

SEQ ID NO: 1250 - RNA, 21 nt, Artificial Sequence
  source: /note="Description of Artificial Sequence: Synthetic oligonucleotide"
ucacuugaggaggcgagucua

SEQ ID NO: 1251 - RNA, 21 nt, Artificial Sequence
  source: /note="Description of Artificial Sequence: Synthetic oligonucleotide"
agucuagcagauucuuucaga

SEQ ID NO: 1252 - RNA, 21 nt, Artificial Sequence
  source: /note="Description of Artificial Sequence: Synthetic oligonucleotide"
auucuuucagaggugcuaaaa

SEQ ID NO: 1253 - RNA, 21 nt, Artificial Sequence
  source: /note="Description of Artificial Sequence: Synthetic oligonucleotide"
uucuuucagaggugcuaaagu

SEQ ID NO: 1254 - RNA, 21 nt, Artificial Sequence
  source: /note="Description of Artificial Sequence: Synthetic oligonucleotide"
gugcuaaaguuucccaucuuu

SEQ ID NO: 1255 - RNA, 21 nt, Artificial Sequence
  source: /note="Description of Artificial Sequence: Synthetic oligonucleotide"
ucccaucuuugugcagcuaca

SEQ ID NO: 1256 - RNA, 21 nt, Artificial Sequence
  source: /note="Description of Artificial Sequence: Synthetic oligonucleotide"
cugccugugacguggaggaua

SEQ ID NO: 1257 - RNA, 21 nt, Artificial Sequence
  source: /note="Description of Artificial Sequence: Synthetic oligonucleotide"
ugugacguggaggaucccaga

SEQ ID NO: 1258 - RNA, 21 nt, Artificial Sequence
  source: /note="Description of Artificial Sequence: Synthetic oligonucleotide"
ucugagcugaguugguuuuau

SEQ ID NO: 1259 - RNA, 21 nt, Artificial Sequence
  source: /note="Description of Artificial Sequence: Synthetic oligonucleotide"
aguugguuuuaugaaaagcua

SEQ ID NO: 1260 - RNA, 21 nt, Artificial Sequence
  source: /note="Description of Artificial Sequence: Synthetic oligonucleotide"
uugguuuuaugaaaagcuaga

SEQ ID NO: 1261 - RNA, 21 nt, Artificial Sequence
  source: /note="Description of Artificial Sequence: Synthetic oligonucleotide"
gguuuuaugaaaagcuaggaa

SEQ ID NO: 1262 - RNA, 21 nt, Artificial Sequence
  source: /note="Description of Artificial Sequence: Synthetic oligonucleotide"
guuuuaugaaaagcuaggaaa

SEQ ID NO: 1263 - RNA, 21 nt, Artificial Sequence
  source: /note="Description of Artificial Sequence: Synthetic oligonucleotide"
uuuuaugaaaagcuaggaaga

SEQ ID NO: 1264 - RNA, 21 nt, Artificial Sequence
  source: /note="Description of Artificial Sequence: Synthetic oligonucleotide"
uaugaaaagcuaggaagcaaa

SEQ ID NO: 1265 - RNA, 21 nt, Artificial Sequence
  source: /note="Description of Artificial Sequence: Synthetic oligonucleotide"
cguuaauucagcugguuggga

SEQ ID NO: 1266 - RNA, 21 nt, Artificial Sequence
  source: /note="Description of Artificial Sequence: Synthetic oligonucleotide"
guuaauucagcugguugggaa

SEQ ID NO: 1267 - RNA, 21 nt, Artificial Sequence
  source: /note="Description of Artificial Sequence: Synthetic oligonucleotide"
agcugguugggaaaugacaca

SEQ ID NO: 1268 - RNA, 21 nt, Artificial Sequence
  source: /note="Description of Artificial Sequence: Synthetic oligonucleotide"
ccuauuaauggucagacuguu

SEQ ID NO: 1269 - RNA, 21 nt, Artificial Sequence
  source: /note="Description of Artificial Sequence: Synthetic oligonucleotide"
cuauuaauggucagacuguua

SEQ ID NO: 1270 - RNA, 21 nt, Artificial Sequence
  source: /note="Description of Artificial Sequence: Synthetic oligonucleotide"
gcuggcccaugugugaucuua

SEQ ID NO: 1271 - RNA, 21 nt, Artificial Sequence
  source: /note="Description of Artificial Sequence: Synthetic oligonucleotide"
uggcccaugugugaucuugua

SEQ ID NO: 1272 - RNA, 21 nt, Artificial Sequence
  source: /note="Description of Artificial Sequence: Synthetic oligonucleotide"
ccuaacuaaaauaauguuuaa

SEQ ID NO: 1273 - RNA, 21 nt, Artificial Sequence
  source: /note="Description of Artificial Sequence: Synthetic oligonucleotide"
uuaccuguugaauuuuguauu

SEQ ID NO: 1274 - RNA, 21 nt, Artificial Sequence
  source: /note="Description of Artificial Sequence: Synthetic oligonucleotide"
accuguugaauuuuguauuau

SEQ ID NO: 1275 - RNA, 21 nt, Artificial Sequence
  source: /note="Description of Artificial Sequence: Synthetic oligonucleotide"
uguauuaugugaaucagugaa

SEQ ID NO: 1276 - RNA, 21 nt, Artificial Sequence
  source: /note="Description of Artificial Sequence: Synthetic oligonucleotide"
uaugugaaucagugagauguu

SEQ ID NO: 1277 - RNA, 21 nt, Artificial Sequence
  source: /note="Description of Artificial Sequence: Synthetic oligonucleotide"
gauguuaguagaauaagccuu

SEQ ID NO: 1278 - RNA, 21 nt, Artificial Sequence
  source: /note="Description of Artificial Sequence: Synthetic oligonucleotide"
auguuaguagaauaagccuua

SEQ ID NO: 1279 - RNA, 21 nt, Artificial Sequence
  source: /note="Description of Artificial Sequence: Synthetic oligonucleotide"
uauaauggagauccucaugga

SEQ ID NO: 1280 - RNA, 21 nt, Artificial Sequence
  source: /note="Description of Artificial Sequence: Synthetic oligonucleotide"
gugucugaguuccauuccaaa

SEQ ID NO: 1281 - RNA, 21 nt, Artificial Sequence
  source: /note="Description of Artificial Sequence: Synthetic oligonucleotide"
agucguggaugcccuggugua

SEQ ID NO: 1282 - RNA, 21 nt, Artificial Sequence
  source: /note="Description of Artificial Sequence: Synthetic oligonucleotide"
ugcuaucaaggguaccuggaa

SEQ ID NO: 1283 - RNA, 21 nt, Artificial Sequence
  source: /note="Description of Artificial Sequence: Synthetic oligonucleotide"
ucccagguuugugcccgaaua

SEQ ID NO: 1284 - RNA, 21 nt, Artificial Sequence
  source: /note="Description of Artificial Sequence: Synthetic oligonucleotide"
ccagguuugugcccgaaugaa

SEQ ID NO: 1285 - RNA, 21 nt, Artificial Sequence
  source: /note="Description of Artificial Sequence: Synthetic oligonucleotide"
uggagcaacagugucuagaua

SEQ ID NO: 1286 - RNA, 21 nt, Artificial Sequence
  source: /note="Description of Artificial Sequence: Synthetic oligonucleotide"
cuuuuggaggcagcuaggaaa

SEQ ID NO: 1287 - RNA, 21 nt, Artificial Sequence
  source: /note="Description of Artificial Sequence: Synthetic oligonucleotide"
aagacaaugauuugguguuua

SEQ ID NO: 1288 - RNA, 21 nt, Artificial Sequence
  source: /note="Description of Artificial Sequence: Synthetic oligonucleotide"
gacaaugauuugguguuuaga

SEQ ID NO: 1289 - RNA, 21 nt, Artificial Sequence
  source: /note="Description of Artificial Sequence: Synthetic oligonucleotide"
caaugauuugguguuuagaaa

SEQ ID NO: 1290 - RNA, 21 nt, Artificial Sequence
  source: /note="Description of Artificial Sequence: Synthetic oligonucleotide"
ugccagauaacuuauuacuuu

SEQ ID NO: 1291 - RNA, 21 nt, Artificial Sequence
  source: /note="Description of Artificial Sequence: Synthetic oligonucleotide"
acaccuuuggcucuuacuaau

SEQ ID NO: 1292 - RNA, 21 nt, Artificial Sequence
  source: /note="Description of Artificial Sequence: Synthetic oligonucleotide"
cuggcuccaaaucuuuguaua

SEQ ID NO: 1293 - RNA, 21 nt, Artificial Sequence
  source: /note="Description of Artificial Sequence: Synthetic oligonucleotide"
uggcuccaaaucuuuguauaa

SEQ ID NO: 1294 - RNA, 21 nt, Artificial Sequence
  source: /note="Description of Artificial Sequence: Synthetic oligonucleotide"
ccaaaucuuuguauagucaua

SEQ ID NO: 1295 - RNA, 21 nt, Artificial Sequence
  source: /note="Description of Artificial Sequence: Synthetic oligonucleotide"
agagacaaagugucuaggcua

SEQ ID NO: 1296 - RNA, 21 nt, Artificial Sequence
  source: /note="Description of Artificial Sequence: Synthetic oligonucleotide"
aagugucuaggcuacacagaa

SEQ ID NO: 1297 - RNA, 21 nt, Artificial Sequence
  source: /note="Description of Artificial Sequence: Synthetic oligonucleotide"
agaaacuucugccuugcuuua

SEQ ID NO: 1298 - RNA, 21 nt, Artificial Sequence
  source: /note="Description of Artificial Sequence: Synthetic oligonucleotide"
gaaggauugaauggauacaca

SEQ ID NO: 1299 - RNA, 21 nt, Artificial Sequence
  source: /note="Description of Artificial Sequence: Synthetic oligonucleotide"
ggauugaauggauacaccaaa

SEQ ID NO: 1300 - RNA, 23 nt, Artificial Sequence
  source: /note="Description of Artificial Sequence: Synthetic oligonucleotide"
uugguagaagcccaggaagccgc

SEQ ID NO: 1301 - RNA, 23 nt, Artificial Sequence
  source: /note="Description of Artificial Sequence: Synthetic oligonucleotide"
uacuccuggccuuccgcacaaga

SEQ ID NO: 1302 - RNA, 23 nt, Artificial Sequence
  source: /note="Description of Artificial Sequence: Synthetic oligonucleotide"
aauguuccgacuccuggccuucc

SEQ ID NO: 1303 - RNA, 23 nt, Artificial Sequence
  source: /note="Description of Artificial Sequence: Synthetic oligonucleotide"
uaauguuccgacuccuggccuuc

SEQ ID NO: 1304 - RNA, 23 nt, Artificial Sequence
  source: /note="Description of Artificial Sequence: Synthetic oligonucleotide"
aaagucagacaccagaacguuuu

SEQ ID NO: 1305 - RNA, 23 nt, Artificial Sequence
  source: /note="Description of Artificial Sequence: Synthetic oligonucleotide"
ugucuuuggaccgaaagucagac

SEQ ID NO: 1306 - RNA, 23 nt, Artificial Sequence
  source: /note="Description of Artificial Sequence: Synthetic oligonucleotide"
acgacuucgucuuuggaccgaaa

SEQ ID NO: 1307 - RNA, 23 nt, Artificial Sequence
  source: /note="Description of Artificial Sequence: Synthetic oligonucleotide"
uacgacuucgucuuuggaccgaa

SEQ ID NO: 1308 - RNA, 23 nt, Artificial Sequence
  source: /note="Description of Artificial Sequence: Synthetic oligonucleotide"
uaaggcauccacgacuucgucuu

SEQ ID NO: 1309 - RNA, 23 nt, Artificial Sequence
  source: /note="Description of Artificial Sequence: Synthetic oligonucleotide"
augaagcaggaacauaccaaggc

SEQ ID NO: 1310 - RNA, 23 nt, Artificial Sequence
  source: /note="Description of Artificial Sequence: Synthetic oligonucleotide"
uaaggaaggagggauaaggccac

SEQ ID NO: 1311 - RNA, 23 nt, Artificial Sequence
  source: /note="Description of Artificial Sequence: Synthetic oligonucleotide"
uguacguugucacucacuccucc

SEQ ID NO: 1312 - RNA, 23 nt, Artificial Sequence
  source: /note="Description of Artificial Sequence: Synthetic oligonucleotide"
uaaggguacguugucacucacuc

SEQ ID NO: 1313 - RNA, 23 nt, Artificial Sequence
  source: /note="Description of Artificial Sequence: Synthetic oligonucleotide"
uugaugguuguuuuggcaucaau

SEQ ID NO: 1314 - RNA, 23 nt, Artificial Sequence
  source: /note="Description of Artificial Sequence: Synthetic oligonucleotide"
uugacuuuagggcagaugucgua

SEQ ID NO: 1315 - RNA, 23 nt, Artificial Sequence
  source: /note="Description of Artificial Sequence: Synthetic oligonucleotide"
uuccacaugaagaaaguucgugg

SEQ ID NO: 1316 - RNA, 23 nt, Artificial Sequence
  source: /note="Description of Artificial Sequence: Synthetic oligonucleotide"
uaagguagagguucccugugcag

SEQ ID NO: 1317 - RNA, 23 nt, Artificial Sequence
  source: /note="Description of Artificial Sequence: Synthetic oligonucleotide"
uaaggcauaucucucccagcacc

SEQ ID NO: 1318 - RNA, 23 nt, Artificial Sequence
  source: /note="Description of Artificial Sequence: Synthetic oligonucleotide"
uucgaaggcauaucucucccagc

SEQ ID NO: 1319 - RNA, 23 nt, Artificial Sequence
  source: /note="Description of Artificial Sequence: Synthetic oligonucleotide"
uauccucgaaggcauaucucucc

SEQ ID NO: 1320 - RNA, 23 nt, Artificial Sequence
  source: /note="Description of Artificial Sequence: Synthetic oligonucleotide"
uaaauauccucgaaggcauaucu

SEQ ID NO: 1321 - RNA, 23 nt, Artificial Sequence
  source: /note="Description of Artificial Sequence: Synthetic oligonucleotide"
auccaaauauccucgaaggcaua

SEQ ID NO: 1322 - RNA, 23 nt, Artificial Sequence
  source: /note="Description of Artificial Sequence: Synthetic oligonucleotide"
uucucuuccaagaaccugaaugc

SEQ ID NO: 1323 - RNA, 23 nt, Artificial Sequence
  source: /note="Description of Artificial Sequence: Synthetic oligonucleotide"
uauccaucccuucugaggaugac

SEQ ID NO: 1324 - RNA, 23 nt, Artificial Sequence
  source: /note="Description of Artificial Sequence: Synthetic oligonucleotide"
augcucucaucccagggcaggau

SEQ ID NO: 1325 - RNA, 23 nt, Artificial Sequence
  source: /note="Description of Artificial Sequence: Synthetic oligonucleotide"
ucucauguauccaccuuugucuu

SEQ ID NO: 1326 - RNA, 23 nt, Artificial Sequence
  source: /note="Description of Artificial Sequence: Synthetic oligonucleotide"
uuugcucauguauccaccuuugu

SEQ ID NO: 1327 - RNA, 23 nt, Artificial Sequence
  source: /note="Description of Artificial Sequence: Synthetic oligonucleotide"
aaaucuugcucauguauccaccu

SEQ ID NO: 1328 - RNA, 23 nt, Artificial Sequence
  source: /note="Description of Artificial Sequence: Synthetic oligonucleotide"
uaaaucuugcucauguauccacc

SEQ ID NO: 1329 - RNA, 23 nt, Artificial Sequence
  source: /note="Description of Artificial Sequence: Synthetic oligonucleotide"
uugcaaaucuugcucauguaucc

SEQ ID NO: 1330 - RNA, 23 nt, Artificial Sequence
  source: /note="Description of Artificial Sequence: Synthetic oligonucleotide"
uagcaaguugcaaaucuugcuca

SEQ ID NO: 1331 - RNA, 23 nt, Artificial Sequence
  source: /note="Description of Artificial Sequence: Synthetic oligonucleotide"
uguagcaaguugcaaaucuugcu

SEQ ID NO: 1332 - RNA, 23 nt, Artificial Sequence
  source: /note="Description of Artificial Sequence: Synthetic oligonucleotide"
ucuaauggguagcaaguugcaaa

SEQ ID NO: 1333 - RNA, 23 nt, Artificial Sequence
  source: /note="Description of Artificial Sequence: Synthetic oligonucleotide"
uauccuaauggguagcaaguugc

SEQ ID NO: 1334 - RNA, 23 nt, Artificial Sequence
  source: /note="Description of Artificial Sequence: Synthetic oligonucleotide"
ucucuggacaaucgcaauggcag

SEQ ID NO: 1335 - RNA, 23 nt, Artificial Sequence
  source: /note="Description of Artificial Sequence: Synthetic oligonucleotide"
uucaccagucucuggacaaucgc

SEQ ID NO: 1336 - RNA, 23 nt, Artificial Sequence
  source: /note="Description of Artificial Sequence: Synthetic oligonucleotide"
uaucuggaagccaugucaccagu

SEQ ID NO: 1337 - RNA, 23 nt, Artificial Sequence
  source: /note="Description of Artificial Sequence: Synthetic oligonucleotide"
uacaucgucgggcauaucuggaa

SEQ ID NO: 1338 - RNA, 23 nt, Artificial Sequence
  source: /note="Description of Artificial Sequence: Synthetic oligonucleotide"
uaggucacccacugcaaccacag

SEQ ID NO: 1339 - RNA, 23 nt, Artificial Sequence
  source: /note="Description of Artificial Sequence: Synthetic oligonucleotide"
ucucacuggcauuugggaccugg

SEQ ID NO: 1340 - RNA, 23 nt, Artificial Sequence
  source: /note="Description of Artificial Sequence: Synthetic oligonucleotide"
uagacucgccuccucaagugacu

SEQ ID NO: 1341 - RNA, 23 nt, Artificial Sequence
  source: /note="Description of Artificial Sequence: Synthetic oligonucleotide"
ucugaaagaaucugcuagacucg

SEQ ID NO: 1342 - RNA, 23 nt, Artificial Sequence
  source: /note="Description of Artificial Sequence: Synthetic oligonucleotide"
uuuuagcaccucugaaagaaucu

SEQ ID NO: 1343 - RNA, 23 nt, Artificial Sequence
  source: /note="Description of Artificial Sequence: Synthetic oligonucleotide"
acuuuagcaccucugaaagaauc

SEQ ID NO: 1344 - RNA, 23 nt, Artificial Sequence
  source: /note="Description of Artificial Sequence: Synthetic oligonucleotide"
aaagaugggaaacuuuagcaccu

SEQ ID NO: 1345 - RNA, 23 nt, Artificial Sequence
  source: /note="Description of Artificial Sequence: Synthetic oligonucleotide"
uguagcugcacaaagaugggaaa

SEQ ID NO: 1346 - RNA, 23 nt, Artificial Sequence
  source: /note="Description of Artificial Sequence: Synthetic oligonucleotide"
uauccuccacgucacaggcaggg

SEQ ID NO: 1347 - RNA, 23 nt, Artificial Sequence
  source: /note="Description of Artificial Sequence: Synthetic oligonucleotide"
ucugggauccuccacgucacagg

SEQ ID NO: 1348 - RNA, 23 nt, Artificial Sequence
  source: /note="Description of Artificial Sequence: Synthetic oligonucleotide"
auaaaaccaacucagcucagagg

SEQ ID NO: 1349 - RNA, 23 nt, Artificial Sequence
  source: /note="Description of Artificial Sequence: Synthetic oligonucleotide"
uagcuuuucauaaaaccaacuca

SEQ ID NO: 1350 - RNA, 23 nt, Artificial Sequence
  source: /note="Description of Artificial Sequence: Synthetic oligonucleotide"
ucuagcuuuucauaaaaccaacu

SEQ ID NO: 1351 - RNA, 23 nt, Artificial Sequence
  source: /note="Description of Artificial Sequence: Synthetic oligonucleotide"
uuccuagcuuuucauaaaaccaa

SEQ ID NO: 1352 - RNA, 23 nt, Artificial Sequence
  source: /note="Description of Artificial Sequence: Synthetic oligonucleotide"
uuuccuagcuuuucauaaaacca

SEQ ID NO: 1353 - RNA, 23 nt, Artificial Sequence
  source: /note="Description of Artificial Sequence: Synthetic oligonucleotide"
ucuuccuagcuuuucauaaaacc

SEQ ID NO: 1354 - RNA, 23 nt, Artificial Sequence
  source: /note="Description of Artificial Sequence: Synthetic oligonucleotide"
uuugcuuccuagcuuuucauaaa

SEQ ID NO: 1355 - RNA, 23 nt, Artificial Sequence
  source: /note="Description of Artificial Sequence: Synthetic oligonucleotide"
ucccaaccagcugaauuaacgca

SEQ ID NO: 1356 - RNA, 23 nt, Artificial Sequence
  source: /note="Description of Artificial Sequence: Synthetic oligonucleotide"
uucccaaccagcugaauuaacgc

SEQ ID NO: 1357 - RNA, 23 nt, Artificial Sequence
  source: /note="Description of Artificial Sequence: Synthetic oligonucleotide"
ugugucauuucccaaccagcuga

SEQ ID NO: 1358 - RNA, 23 nt, Artificial Sequence
  source: /note="Description of Artificial Sequence: Synthetic oligonucleotide"
aacagucugaccauuaauagggc

SEQ ID NO: 1359 - RNA, 23 nt, Artificial Sequence
  source: /note="Description of Artificial Sequence: Synthetic oligonucleotide"
uaacagucugaccauuaauaggg

SEQ ID NO: 1360 - RNA, 23 nt, Artificial Sequence
  source: /note="Description of Artificial Sequence: Synthetic oligonucleotide"
uaagaucacacaugggccagccu

SEQ ID NO: 1361 - RNA, 23 nt, Artificial Sequence
  source: /note="Description of Artificial Sequence: Synthetic oligonucleotide"
uacaagaucacacaugggccagc

SEQ ID NO: 1362 - RNA, 23 nt, Artificial Sequence
  source: /note="Description of Artificial Sequence: Synthetic oligonucleotide"
uuaaacauuauuuuaguuaggug

SEQ ID NO: 1363 - RNA, 23 nt, Artificial Sequence
  source: /note="Description of Artificial Sequence: Synthetic oligonucleotide"
aauacaaaauucaacagguaaca

SEQ ID NO: 1364 - RNA, 23 nt, Artificial Sequence
  source: /note="Description of Artificial Sequence: Synthetic oligonucleotide"
auaauacaaaauucaacagguaa

SEQ ID NO: 1365 - RNA, 23 nt, Artificial Sequence
  source: /note="Description of Artificial Sequence: Synthetic oligonucleotide"
uucacugauucacauaauacaaa

SEQ ID NO: 1366 - RNA, 23 nt, Artificial Sequence
  source: /note="Description of Artificial Sequence: Synthetic oligonucleotide"
aacaucucacugauucacauaau

SEQ ID NO: 1367 - RNA, 23 nt, Artificial Sequence
  source: /note="Description of Artificial Sequence: Synthetic oligonucleotide"
aaggcuuauucuacuaacaucuc

SEQ ID NO: 1368 - RNA, 23 nt, Artificial Sequence
  source: /note="Description of Artificial Sequence: Synthetic oligonucleotide"
uaaggcuuauucuacuaacaucu

SEQ ID NO: 1369 - RNA, 23 nt, Artificial Sequence
  source: /note="Description of Artificial Sequence: Synthetic oligonucleotide"
uccaugaggaucuccauuauacg

SEQ ID NO: 1370 - RNA, 23 nt, Artificial Sequence
  source: /note="Description of Artificial Sequence: Synthetic oligonucleotide"
uuuggaauggaacucagacacca

SEQ ID NO: 1371 - RNA, 23 nt, Artificial Sequence
  source: /note="Description of Artificial Sequence: Synthetic oligonucleotide"
uacaccagggcauccacgacuuc

SEQ ID NO: 1372 - RNA, 23 nt, Artificial Sequence
  source: /note="Description of Artificial Sequence: Synthetic oligonucleotide"
uuccagguacccuugauagcaca

SEQ ID NO: 1373 - RNA, 23 nt, Artificial Sequence
  source: /note="Description of Artificial Sequence: Synthetic oligonucleotide"
uauucgggcacaaaccugggaug

SEQ ID NO: 1374 - RNA, 23 nt, Artificial Sequence
  source: /note="Description of Artificial Sequence: Synthetic oligonucleotide"
uucauucgggcacaaaccuggga

SEQ ID NO: 1375 - RNA, 23 nt, Artificial Sequence
  source: /note="Description of Artificial Sequence: Synthetic oligonucleotide"
uaucuagacacuguugcuccaga

SEQ ID NO: 1376 - RNA, 23 nt, Artificial Sequence
  source: /note="Description of Artificial Sequence: Synthetic oligonucleotide"
uuuccuagcugccuccaaaagua

SEQ ID NO: 1377 - RNA, 23 nt, Artificial Sequence
  source: /note="Description of Artificial Sequence: Synthetic oligonucleotide"
uaaacaccaaaucauugucuuug

SEQ ID NO: 1378 - RNA, 23 nt, Artificial Sequence
  source: /note="Description of Artificial Sequence: Synthetic oligonucleotide"
ucuaaacaccaaaucauugucuu

SEQ ID NO: 1379 - RNA, 23 nt, Artificial Sequence
  source: /note="Description of Artificial Sequence: Synthetic oligonucleotide"
uuucuaaacaccaaaucauuguc

SEQ ID NO: 1380 - RNA, 23 nt, Artificial Sequence
  source: /note="Description of Artificial Sequence: Synthetic oligonucleotide"
aaaguaauaaguuaucuggcagg

SEQ ID NO: 1381 - RNA, 23 nt, Artificial Sequence
  source: /note="Description of Artificial Sequence: Synthetic oligonucleotide"
auuaguaagagccaaaggugucc

SEQ ID NO: 1382 - RNA, 23 nt, Artificial Sequence
  source: /note="Description of Artificial Sequence: Synthetic oligonucleotide"
uauacaaagauuuggagccagug

SEQ ID NO: 1383 - RNA, 23 nt, Artificial Sequence
  source: /note="Description of Artificial Sequence: Synthetic oligonucleotide"
uuauacaaagauuuggagccagu

SEQ ID NO: 1384 - RNA, 23 nt, Artificial Sequence
  source: /note="Description of Artificial Sequence: Synthetic oligonucleotide"
uaugacuauacaaagauuuggag

SEQ ID NO: 1385 - RNA, 23 nt, Artificial Sequence
  source: /note="Description of Artificial Sequence: Synthetic oligonucleotide"
uagccuagacacuuugucucuag

SEQ ID NO: 1386 - RNA, 23 nt, Artificial Sequence
  source: /note="Description of Artificial Sequence: Synthetic oligonucleotide"
uucuguguagccuagacacuuug

SEQ ID NO: 1387 - RNA, 23 nt, Artificial Sequence
  source: /note="Description of Artificial Sequence: Synthetic oligonucleotide"
uaaagcaaggcagaaguuucuac

SEQ ID NO: 1388 - RNA, 23 nt, Artificial Sequence
  source: /note="Description of Artificial Sequence: Synthetic oligonucleotide"
uguguauccauucaauccuucug

SEQ ID NO: 1389 - RNA, 23 nt, Artificial Sequence
  source: /note="Description of Artificial Sequence: Synthetic oligonucleotide"
uuugguguauccauucaauccuu

SEQ ID NO: 1390 - RNA, 21 nt, Artificial Sequence
  source: /note="Description of Artificial Sequence: Synthetic oligonucleotide"
ggcuuccugggcuucuaccaa

SEQ ID NO: 1391 - RNA, 21 nt, Artificial Sequence
  source: /note="Description of Artificial Sequence: Synthetic oligonucleotide"
uugugcggaaggccaggagua

SEQ ID NO: 1392 - RNA, 21 nt, Artificial Sequence
  source: /note="Description of Artificial Sequence: Synthetic oligonucleotide"
aaggccaggagucggaacauu

SEQ ID NO: 1393 - RNA, 21 nt, Artificial Sequence
  source: /note="Description of Artificial Sequence: Synthetic oligonucleotide"
aggccaggagucggaacauua

SEQ ID NO: 1394 - RNA, 21 nt, Artificial Sequence
  source: /note="Description of Artificial Sequence: Synthetic oligonucleotide"
aacguucuggugucugacuuu

SEQ ID NO: 1395 - RNA, 21 nt, Artificial Sequence
  source: /note="Description of Artificial Sequence: Synthetic oligonucleotide"
cugacuuucgguccaaagaca

SEQ ID NO: 1396 - RNA, 21 nt, Artificial Sequence
  source: /note="Description of Artificial Sequence: Synthetic oligonucleotide"
ucgguccaaagacgaagucgu

SEQ ID NO: 1397 - RNA, 21 nt, Artificial Sequence
  source: /note="Description of Artificial Sequence: Synthetic oligonucleotide"
cgguccaaagacgaagucgua

SEQ ID NO: 1398 - RNA, 21 nt, Artificial Sequence
  source: /note="Description of Artificial Sequence: Synthetic oligonucleotide"
gacgaagucguggaugccuua

SEQ ID NO: 1399 - RNA, 21 nt, Artificial Sequence
  source: /note="Description of Artificial Sequence: Synthetic oligonucleotide"
cuugguauguuccugcuucau

SEQ ID NO: 1400 - RNA, 21 nt, Artificial Sequence
  source: /note="Description of Artificial Sequence: Synthetic oligonucleotide"
ggccuuaucccuccuuccuua

SEQ ID NO: 1401 - RNA, 21 nt, Artificial Sequence
  source: /note="Description of Artificial Sequence: Synthetic oligonucleotide"
aggagugagugacaacguaca

SEQ ID NO: 1402 - RNA, 21 nt, Artificial Sequence
  source: /note="Description of Artificial Sequence: Synthetic oligonucleotide"
gugagugacaacguacccuua

SEQ ID NO: 1403 - RNA, 21 nt, Artificial Sequence
  source: /note="Description of Artificial Sequence: Synthetic oligonucleotide"
ugaugccaaaacaaccaucaa

SEQ ID NO: 1404 - RNA, 21 nt, Artificial Sequence
  source: /note="Description of Artificial Sequence: Synthetic oligonucleotide"
cgacaucugcccuaaagucaa

SEQ ID NO: 1405 - RNA, 21 nt, Artificial Sequence
  source: /note="Description of Artificial Sequence: Synthetic oligonucleotide"
acgaacuuucuucauguggaa

SEQ ID NO: 1406 - RNA, 21 nt, Artificial Sequence
  source: /note="Description of Artificial Sequence: Synthetic oligonucleotide"
gcacagggaaccucuaccuua

SEQ ID NO: 1407 - RNA, 21 nt, Artificial Sequence
  source: /note="Description of Artificial Sequence: Synthetic oligonucleotide"
ugcugggagagauaugccuua

SEQ ID NO: 1408 - RNA, 21 nt, Artificial Sequence
  source: /note="Description of Artificial Sequence: Synthetic oligonucleotide"
ugggagagauaugccuucgaa

SEQ ID NO: 1409 - RNA, 21 nt, Artificial Sequence
  source: /note="Description of Artificial Sequence: Synthetic oligonucleotide"
agagauaugccuucgaggaua

SEQ ID NO: 1410 - RNA, 21 nt, Artificial Sequence
  source: /note="Description of Artificial Sequence: Synthetic oligonucleotide"
auaugccuucgaggauauuua

SEQ ID NO: 1411 - RNA, 21 nt, Artificial Sequence
  source: /note="Description of Artificial Sequence: Synthetic oligonucleotide"
ugccuucgaggauauuuggau

SEQ ID NO: 1412 - RNA, 21 nt, Artificial Sequence
  source: /note="Description of Artificial Sequence: Synthetic oligonucleotide"
auucagguucuuggaagagaa

SEQ ID NO: 1413 - RNA, 21 nt, Artificial Sequence
  source: /note="Description of Artificial Sequence: Synthetic oligonucleotide"
cauccucagaagggauggaua

SEQ ID NO: 1414 - RNA, 21 nt, Artificial Sequence
  source: /note="Description of Artificial Sequence: Synthetic oligonucleotide"
ccugcccugggaugagagcau

SEQ ID NO: 1415 - RNA, 21 nt, Artificial Sequence
  source: /note="Description of Artificial Sequence: Synthetic oligonucleotide"
gacaaagguggauacaugaga

SEQ ID NO: 1416 - RNA, 21 nt, Artificial Sequence
  source: /note="Description of Artificial Sequence: Synthetic oligonucleotide"
aaagguggauacaugagcaaa

SEQ ID NO: 1417 - RNA, 21 nt, Artificial Sequence
  source: /note="Description of Artificial Sequence: Synthetic oligonucleotide"
guggauacaugagcaagauuu

SEQ ID NO: 1418 - RNA, 21 nt, Artificial Sequence
  source: /note="Description of Artificial Sequence: Synthetic oligonucleotide"
uggauacaugagcaagauuua

SEQ ID NO: 1419 - RNA, 21 nt, Artificial Sequence
  source: /note="Description of Artificial Sequence: Synthetic oligonucleotide"
auacaugagcaagauuugcaa

SEQ ID NO: 1420 - RNA, 21 nt, Artificial Sequence
  source: /note="Description of Artificial Sequence: Synthetic oligonucleotide"
agcaagauuugcaacuugcua

SEQ ID NO: 1421 - RNA, 21 nt, Artificial Sequence
  source: /note="Description of Artificial Sequence: Synthetic oligonucleotide"
caagauuugcaacuugcuaca

SEQ ID NO: 1422 - RNA, 21 nt, Artificial Sequence
  source: /note="Description of Artificial Sequence: Synthetic oligonucleotide"
ugcaacuugcuacccauuaga

SEQ ID NO: 1423 - RNA, 21 nt, Artificial Sequence
  source: /note="Description of Artificial Sequence: Synthetic oligonucleotide"
aacuugcuacccauuaggaua

SEQ ID NO: 1424 - RNA, 21 nt, Artificial Sequence
  source: /note="Description of Artificial Sequence: Synthetic oligonucleotide"
gccauugcgauuguccagaga

SEQ ID NO: 1425 - RNA, 21 nt, Artificial Sequence
  source: /note="Description of Artificial Sequence: Synthetic oligonucleotide"
gauuguccagagacuggugaa

SEQ ID NO: 1426 - RNA, 21 nt, Artificial Sequence
  source: /note="Description of Artificial Sequence: Synthetic oligonucleotide"
uggugacauggcuuccagaua

SEQ ID NO: 1427 - RNA, 21 nt, Artificial Sequence
  source: /note="Description of Artificial Sequence: Synthetic oligonucleotide"
ccagauaugcccgacgaugua

SEQ ID NO: 1428 - RNA, 21 nt, Artificial Sequence
  source: /note="Description of Artificial Sequence: Synthetic oligonucleotide"
gugguugcagugggugaccua

SEQ ID NO: 1429 - RNA, 21 nt, Artificial Sequence
  source: /note="Description of Artificial Sequence: Synthetic oligonucleotide"
aggucccaaaugccagugaga

SEQ ID NO: 1430 - RNA, 21 nt, Artificial Sequence
  source: /note="Description of Artificial Sequence: Synthetic oligonucleotide"
ucacuugaggaggcgagucua

SEQ ID NO: 1431 - RNA, 21 nt, Artificial Sequence
  source: /note="Description of Artificial Sequence: Synthetic oligonucleotide"
agucuagcagauucuuucaga

SEQ ID NO: 1432 - RNA, 21 nt, Artificial Sequence
  source: /note="Description of Artificial Sequence: Synthetic oligonucleotide"
auucuuucagaggugcuaaaa

SEQ ID NO: 1433 - RNA, 21 nt, Artificial Sequence
  source: /note="Description of Artificial Sequence: Synthetic oligonucleotide"
uucuuucagaggugcuaaagu

SEQ ID NO: 1434 - RNA, 21 nt, Artificial Sequence
  source: /note="Description of Artificial Sequence: Synthetic oligonucleotide"
gugcuaaaguuucccaucuuu

SEQ ID NO: 1435 - RNA, 21 nt, Artificial Sequence
  source: /note="Description of Artificial Sequence: Synthetic oligonucleotide"
ucccaucuuugugcagcuaca

SEQ ID NO: 1436 - RNA, 21 nt, Artificial Sequence
  source: /note="Description of Artificial Sequence: Synthetic oligonucleotide"
cugccugugacguggaggaua

SEQ ID NO: 1437 - RNA, 21 nt, Artificial Sequence
  source: /note="Description of Artificial Sequence: Synthetic oligonucleotide"
ugugacguggaggaucccaga

SEQ ID NO: 1438 - RNA, 21 nt, Artificial Sequence
  source: /note="Description of Artificial Sequence: Synthetic oligonucleotide"
ucugagcugaguugguuuuau

SEQ ID NO: 1439 - RNA, 21 nt, Artificial Sequence
  source: /note="Description of Artificial Sequence: Synthetic oligonucleotide"
aguugguuuuaugaaaagcua

SEQ ID NO: 1440 - RNA, 21 nt, Artificial Sequence
  source: /note="Description of Artificial Sequence: Synthetic oligonucleotide"
uugguuuuaugaaaagcuaga

SEQ ID NO: 1441 - RNA, 21 nt, Artificial Sequence
  source: /note="Description of Artificial Sequence: Synthetic oligonucleotide"
gguuuuaugaaaagcuaggaa

SEQ ID NO: 1442 - RNA, 21 nt, Artificial Sequence
  source: /note="Description of Artificial Sequence: Synthetic oligonucleotide"
guuuuaugaaaagcuaggaaa

SEQ ID NO: 1443 - RNA, 21 nt, Artificial Sequence
  source: /note="Description of Artificial Sequence: Synthetic oligonucleotide"
uuuuaugaaaagcuaggaaga

SEQ ID NO: 1444 - RNA, 21 nt, Artificial Sequence
  source: /note="Description of Artificial Sequence: Synthetic oligonucleotide"
uaugaaaagcuaggaagcaaa

SEQ ID NO: 1445 - RNA, 21 nt, Artificial Sequence
  source: /note="Description of Artificial Sequence: Synthetic oligonucleotide"
cguuaauucagcugguuggga

SEQ ID NO: 1446 - RNA, 21 nt, Artificial Sequence
  source: /note="Description of Artificial Sequence: Synthetic oligonucleotide"
guuaauucagcugguugggaa

SEQ ID NO: 1447 - RNA, 21 nt, Artificial Sequence
  source: /note="Description of Artificial Sequence: Synthetic oligonucleotide"
agcugguugggaaaugacaca

SEQ ID NO: 1448 - RNA, 21 nt, Artificial Sequence
  source: /note="Description of Artificial Sequence: Synthetic oligonucleotide"
ccuauuaauggucagacuguu

SEQ ID NO: 1449 - RNA, 21 nt, Artificial Sequence
  source: /note="Description of Artificial Sequence: Synthetic oligonucleotide"
cuauuaauggucagacuguua

SEQ ID NO: 1450 - RNA, 21 nt, Artificial Sequence
  source: /note="Description of Artificial Sequence: Synthetic oligonucleotide"
gcuggcccaugugugaucuua

SEQ ID NO: 1451 - RNA, 21 nt, Artificial Sequence
  source: /note="Description of Artificial Sequence: Synthetic oligonucleotide"
uggcccaugugugaucuugua

SEQ ID NO: 1452 - RNA, 21 nt, Artificial Sequence
  source: /note="Description of Artificial Sequence: Synthetic oligonucleotide"
ccuaacuaaaauaauguuuaa

SEQ ID NO: 1453 - RNA, 21 nt, Artificial Sequence
  source: /note="Description of Artificial Sequence: Synthetic oligonucleotide"
uuaccuguugaauuuuguauu

SEQ ID NO: 1454 - RNA, 21 nt, Artificial Sequence
  source: /note="Description of Artificial Sequence: Synthetic oligonucleotide"
accuguugaauuuuguauuau

SEQ ID NO: 1455 - RNA, 21 nt, Artificial Sequence
  source: /note="Description of Artificial Sequence: Synthetic oligonucleotide"
uguauuaugugaaucagugaa

SEQ ID NO: 1456 - RNA, 21 nt, Artificial Sequence
  source: /note="Description of Artificial Sequence: Synthetic oligonucleotide"
uaugugaaucagugagauguu

SEQ ID NO: 1457 - RNA, 21 nt, Artificial Sequence
  source: /note="Description of Artificial Sequence: Synthetic oligonucleotide"
gauguuaguagaauaagccuu

SEQ ID NO: 1458 - RNA, 21 nt, Artificial Sequence
  source: /note="Description of Artificial Sequence: Synthetic oligonucleotide"
auguuaguagaauaagccuua

SEQ ID NO: 1459 - RNA, 21 nt, Artificial Sequence
  source: /note="Description of Artificial Sequence: Synthetic oligonucleotide"
uauaauggagauccucaugga

SEQ ID NO: 1460 - RNA, 21 nt, Artificial Sequence
  source: /note="Description of Artificial Sequence: Synthetic oligonucleotide"
gugucugaguuccauuccaaa

SEQ ID NO: 1461 - RNA, 21 nt, Artificial Sequence
  source: /note="Description of Artificial Sequence: Synthetic oligonucleotide"
agucguggaugcccuggugua

SEQ ID NO: 1462 - RNA, 21 nt, Artificial Sequence
  source: /note="Description of Artificial Sequence: Synthetic oligonucleotide"
ugcuaucaaggguaccuggaa

SEQ ID NO: 1463 - RNA, 21 nt, Artificial Sequence
  source: /note="Description of Artificial Sequence: Synthetic oligonucleotide"
ucccagguuugugcccgaaua

SEQ ID NO: 1464 - RNA, 21 nt, Artificial Sequence
  source: /note="Description of Artificial Sequence: Synthetic oligonucleotide"
ccagguuugugcccgaaugaa

SEQ ID NO: 1465 - RNA, 21 nt, Artificial Sequence
  source: /note="Description of Artificial Sequence: Synthetic oligonucleotide"
uggagcaacagugucuagaua

SEQ ID NO: 1466 - RNA, 21 nt, Artificial Sequence
  source: /note="Description of Artificial Sequence: Synthetic oligonucleotide"
cuuuuggaggcagcuaggaaa

SEQ ID NO: 1467 - RNA, 21 nt, Artificial Sequence
  source: /note="Description of Artificial Sequence: Synthetic oligonucleotide"
aagacaaugauuugguguuua

SEQ ID NO: 1468 - RNA, 21 nt, Artificial Sequence
  source: /note="Description of Artificial Sequence: Synthetic oligonucleotide"
gacaaugauuugguguuuaga

SEQ ID NO: 1469 - RNA, 21 nt, Artificial Sequence
  source: /note="Description of Artificial Sequence: Synthetic oligonucleotide"
caaugauuugguguuuagaaa

SEQ ID NO: 1470 - RNA, 21 nt, Artificial Sequence
  source: /note="Description of Artificial Sequence: Synthetic oligonucleotide"
ugccagauaacuuauuacuuu

SEQ ID NO: 1471 - RNA, 21 nt, Artificial Sequence
  source: /note="Description of Artificial Sequence: Synthetic oligonucleotide"
acaccuuuggcucuuacuaau

SEQ ID NO: 1472 - RNA, 21 nt, Artificial Sequence
  source: /note="Description of Artificial Sequence: Synthetic oligonucleotide"
cuggcuccaaaucuuuguaua

SEQ ID NO: 1473 - RNA, 21 nt, Artificial Sequence
  source: /note="Description of Artificial Sequence: Synthetic oligonucleotide"
uggcuccaaaucuuuguauaa

SEQ ID NO: 1474 - RNA, 21 nt, Artificial Sequence
  source: /note="Description of Artificial Sequence: Synthetic oligonucleotide"
ccaaaucuuuguauagucaua

SEQ ID NO: 1475 - RNA, 21 nt, Artificial Sequence
  source: /note="Description of Artificial Sequence: Synthetic oligonucleotide"
agagacaaagugucuaggcua

SEQ ID NO: 1476 - RNA, 21 nt, Artificial Sequence
  source: /note="Description of Artificial Sequence: Synthetic oligonucleotide"
aagugucuaggcuacacagaa

SEQ ID NO: 1477 - RNA, 21 nt, Artificial Sequence
  source: /note="Description of Artificial Sequence: Synthetic oligonucleotide"
agaaacuucugccuugcuuua

SEQ ID NO: 1478 - RNA, 21 nt, Artificial Sequence
  source: /note="Description of Artificial Sequence: Synthetic oligonucleotide"
gaaggauugaauggauacaca

SEQ ID NO: 1479 - RNA, 21 nt, Artificial Sequence
  source: /note="Description of Artificial Sequence: Synthetic oligonucleotide"
ggauugaauggauacaccaaa

SEQ ID NO: 1480 - RNA, 23 nt, Artificial Sequence
  source: /note="Description of Artificial Sequence: Synthetic oligonucleotide"
uugguagaagcccaggaagccgc

SEQ ID NO: 1481 - RNA, 23 nt, Artificial Sequence
  source: /note="Description of Artificial Sequence: Synthetic oligonucleotide"
uacuccuggccuuccgcacaaga

SEQ ID NO: 1482 - RNA, 23 nt, Artificial Sequence
  source: /note="Description of Artificial Sequence: Synthetic oligonucleotide"
aauguuccgacuccuggccuucc

SEQ ID NO: 1483 - RNA, 23 nt, Artificial Sequence
  source: /note="Description of Artificial Sequence: Synthetic oligonucleotide"
uaauguuccgacuccuggccuuc

SEQ ID NO: 1484 - RNA, 23 nt, Artificial Sequence
  source: /note="Description of Artificial Sequence: Synthetic oligonucleotide"
aaagucagacaccagaacguuuu

SEQ ID NO: 1485 - RNA, 23 nt, Artificial Sequence
  source: /note="Description of Artificial Sequence: Synthetic oligonucleotide"
ugucuuuggaccgaaagucagac

SEQ ID NO: 1486 - RNA, 23 nt, Artificial Sequence
  source: /note="Description of Artificial Sequence: Synthetic oligonucleotide"
acgacuucgucuuuggaccgaaa

SEQ ID NO: 1487 - RNA, 23 nt, Artificial Sequence
  source: /note="Description of Artificial Sequence: Synthetic oligonucleotide"
uacgacuucgucuuuggaccgaa

SEQ ID NO: 1488 - RNA, 23 nt, Artificial Sequence
  source: /note="Description of Artificial Sequence: Synthetic oligonucleotide"
uaaggcauccacgacuucgucuu

SEQ ID NO: 1489 - RNA, 23 nt, Artificial Sequence
  source: /note="Description of Artificial Sequence: Synthetic oligonucleotide"
augaagcaggaacauaccaaggc

SEQ ID NO: 1490 - RNA, 23 nt, Artificial Sequence
  source: /note="Description of Artificial Sequence: Synthetic oligonucleotide"
uaaggaaggagggauaaggccac

SEQ ID NO: 1491 - RNA, 23 nt, Artificial Sequence
  source: /note="Description of Artificial Sequence: Synthetic oligonucleotide"
uguacguugucacucacuccucc

SEQ ID NO: 1492 - RNA, 23 nt, Artificial Sequence
  source: /note="Description of Artificial Sequence: Synthetic oligonucleotide"
uaaggguacguugucacucacuc

SEQ ID NO: 1493 - RNA, 23 nt, Artificial Sequence
  source: /note="Description of Artificial Sequence: Synthetic oligonucleotide"
uugaugguuguuuuggcaucaau

SEQ ID NO: 1494 - RNA, 23 nt, Artificial Sequence
  source: /note="Description of Artificial Sequence: Synthetic oligonucleotide"
uugacuuuagggcagaugucgua

SEQ ID NO: 1495 - RNA, 23 nt, Artificial Sequence
  source: /note="Description of Artificial Sequence: Synthetic oligonucleotide"
uuccacaugaagaaaguucgugg

SEQ ID NO: 1496 - RNA, 23 nt, Artificial Sequence
  source: /note="Description of Artificial Sequence: Synthetic oligonucleotide"
uaagguagagguucccugugcag

SEQ ID NO: 1497 - RNA, 23 nt, Artificial Sequence
  source: /note="Description of Artificial Sequence: Synthetic oligonucleotide"
uaaggcauaucucucccagcacc

SEQ ID NO: 1498 - RNA, 23 nt, Artificial Sequence
  source: /note="Description of Artificial Sequence: Synthetic oligonucleotide"
uucgaaggcauaucucucccagc

SEQ ID NO: 1499 - RNA, 23 nt, Artificial Sequence
  source: /note="Description of Artificial Sequence: Synthetic oligonucleotide"
uauccucgaaggcauaucucucc

SEQ ID NO: 1500 - RNA, 23 nt, Artificial Sequence
  source: /note="Description of Artificial Sequence: Synthetic oligonucleotide"
uaaauauccucgaaggcauaucu

SEQ ID NO: 1501 - RNA, 23 nt, Artificial Sequence
  source: /note="Description of Artificial Sequence: Synthetic oligonucleotide"
auccaaauauccucgaaggcaua

SEQ ID NO: 1502 - RNA, 23 nt, Artificial Sequence
  source: /note="Description of Artificial Sequence: Synthetic oligonucleotide"
uucucuuccaagaaccugaaugc

SEQ ID NO: 1503 - RNA, 23 nt, Artificial Sequence
  source: /note="Description of Artificial Sequence: Synthetic oligonucleotide"
uauccaucccuucugaggaugac

SEQ ID NO: 1504 - RNA, 23 nt, Artificial Sequence
  source: /note="Description of Artificial Sequence: Synthetic oligonucleotide"
augcucucaucccagggcaggau

SEQ ID NO: 1505 - RNA, 23 nt, Artificial Sequence
  source: /note="Description of Artificial Sequence: Synthetic oligonucleotide"
ucucauguauccaccuuugucuu

SEQ ID NO: 1506 - RNA, 23 nt, Artificial Sequence
  source: /note="Description of Artificial Sequence: Synthetic oligonucleotide"
uuugcucauguauccaccuuugu

SEQ ID NO: 1507 - RNA, 23 nt, Artificial Sequence
  source: /note="Description of Artificial Sequence: Synthetic oligonucleotide"
aaaucuugcucauguauccaccu

SEQ ID NO: 1508 - RNA, 23 nt, Artificial Sequence
  source: /note="Description of Artificial Sequence: Synthetic oligonucleotide"
uaaaucuugcucauguauccacc

SEQ ID NO: 1509 - RNA, 23 nt, Artificial Sequence
  source: /note="Description of Artificial Sequence: Synthetic oligonucleotide"
uugcaaaucuugcucauguaucc

SEQ ID NO: 1510 - RNA, 23 nt, Artificial Sequence
  source: /note="Description of Artificial Sequence: Synthetic oligonucleotide"
uagcaaguugcaaaucuugcuca

SEQ ID NO: 1511 - RNA, 23 nt, Artificial Sequence
  source: /note="Description of Artificial Sequence: Synthetic oligonucleotide"
uguagcaaguugcaaaucuugcu

SEQ ID NO: 1512 - RNA, 23 nt, Artificial Sequence
  source: /note="Description of Artificial Sequence: Synthetic oligonucleotide"
ucuaauggguagcaaguugcaaa

SEQ ID NO: 1513 - RNA, 23 nt, Artificial Sequence
  source: /note="Description of Artificial Sequence: Synthetic oligonucleotide"
uauccuaauggguagcaaguugc

SEQ ID NO: 1514 - RNA, 23 nt, Artificial Sequence
  source: /note="Description of Artificial Sequence: Synthetic oligonucleotide"
ucucuggacaaucgcaauggcag

SEQ ID NO: 1515 - RNA, 23 nt, Artificial Sequence
  source: /note="Description of Artificial Sequence: Synthetic oligonucleotide"
uucaccagucucuggacaaucgc

SEQ ID NO: 1516 - RNA, 23 nt, Artificial Sequence
  source: /note="Description of Artificial Sequence: Synthetic oligonucleotide"
uaucuggaagccaugucaccagu

SEQ ID NO: 1517 - RNA, 23 nt, Artificial Sequence
  source: /note="Description of Artificial Sequence: Synthetic oligonucleotide"
uacaucgucgggcauaucuggaa

SEQ ID NO: 1518 - RNA, 23 nt, Artificial Sequence
  source: /note="Description of Artificial Sequence: Synthetic oligonucleotide"
uaggucacccacugcaaccacag

SEQ ID NO: 1519 - RNA, 23 nt, Artificial Sequence
  source: /note="Description of Artificial Sequence: Synthetic oligonucleotide"
ucucacuggcauuugggaccugg

SEQ ID NO: 1520 - RNA, 23 nt, Artificial Sequence
  source: /note="Description of Artificial Sequence: Synthetic oligonucleotide"
uagacucgccuccucaagugacu

SEQ ID NO: 1521 - RNA, 23 nt, Artificial Sequence
  source: /note="Description of Artificial Sequence: Synthetic oligonucleotide"
ucugaaagaaucugcuagacucg

SEQ ID NO: 1522 - RNA, 23 nt, Artificial Sequence
  source: /note="Description of Artificial Sequence: Synthetic oligonucleotide"
uuuuagcaccucugaaagaaucu

SEQ ID NO: 1523 - RNA, 23 nt, Artificial Sequence
  source: /note="Description of Artificial Sequence: Synthetic oligonucleotide"
acuuuagcaccucugaaagaauc

SEQ ID NO: 1524 - RNA, 23 nt, Artificial Sequence
  source: /note="Description of Artificial Sequence: Synthetic oligonucleotide"
aaagaugggaaacuuuagcaccu

SEQ ID NO: 1525 - RNA, 23 nt, Artificial Sequence
  source: /note="Description of Artificial Sequence: Synthetic oligonucleotide"
uguagcugcacaaagaugggaaa

SEQ ID NO: 1526 - RNA, 23 nt, Artificial Sequence
  source: /note="Description of Artificial Sequence: Synthetic oligonucleotide"
uauccuccacgucacaggcaggg

SEQ ID NO: 1527 - RNA, 23 nt, Artificial Sequence
  source: /note="Description of Artificial Sequence: Synthetic oligonucleotide"
ucugggauccuccacgucacagg

SEQ ID NO: 1528 - RNA, 23 nt, Artificial Sequence
  source: /note="Description of Artificial Sequence: Synthetic oligonucleotide"
auaaaaccaacucagcucagagg

SEQ ID NO: 1529 - RNA, 23 nt, Artificial Sequence
  source: /note="Description of Artificial Sequence: Synthetic oligonucleotide"
uagcuuuucauaaaaccaacuca

SEQ ID NO: 1530 - RNA, 23 nt, Artificial Sequence
  source: /note="Description of Artificial Sequence: Synthetic oligonucleotide"
ucuagcuuuucauaaaaccaacu

SEQ ID NO: 1531 - RNA, 23 nt, Artificial Sequence
  source: /note="Description of Artificial Sequence: Synthetic oligonucleotide"
uuccuagcuuuucauaaaaccaa

SEQ ID NO: 1532 - RNA, 23 nt, Artificial Sequence
  source: /note="Description of Artificial Sequence: Synthetic oligonucleotide"
uuuccuagcuuuucauaaaacca

SEQ ID NO: 1533 - RNA, 23 nt, Artificial Sequence
  source: /note="Description of Artificial Sequence: Synthetic oligonucleotide"
ucuuccuagcuuuucauaaaacc

SEQ ID NO: 1534 - RNA, 23 nt, Artificial Sequence
  source: /note="Description of Artificial Sequence: Synthetic oligonucleotide"
uuugcuuccuagcuuuucauaaa

SEQ ID NO: 1535 - RNA, 23 nt, Artificial Sequence
  source: /note="Description of Artificial Sequence: Synthetic oligonucleotide"
ucccaaccagcugaauuaacgca

SEQ ID NO: 1536 - RNA, 23 nt, Artificial Sequence
  source: /note="Description of Artificial Sequence: Synthetic oligonucleotide"
uucccaaccagcugaauuaacgc

SEQ ID NO: 1537 - RNA, 23 nt, Artificial Sequence
  source: /note="Description of Artificial Sequence: Synthetic oligonucleotide"
ugugucauuucccaaccagcuga

SEQ ID NO: 1538 - RNA, 23 nt, Artificial Sequence
  source: /note="Description of Artificial Sequence: Synthetic oligonucleotide"
aacagucugaccauuaauagggc

SEQ ID NO: 1539 - RNA, 23 nt, Artificial Sequence
  source: /note="Description of Artificial Sequence: Synthetic oligonucleotide"
uaacagucugaccauuaauaggg

SEQ ID NO: 1540 - RNA, 23 nt, Artificial Sequence
  source: /note="Description of Artificial Sequence: Synthetic oligonucleotide"
uaagaucacacaugggccagccu

SEQ ID NO: 1541 - RNA, 23 nt, Artificial Sequence
  source: /note="Description of Artificial Sequence: Synthetic oligonucleotide"
uacaagaucacacaugggccagc

SEQ ID NO: 1542 - RNA, 23 nt, Artificial Sequence
  source: /note="Description of Artificial Sequence: Synthetic oligonucleotide"
uuaaacauuauuuuaguuaggug

SEQ ID NO: 1543 - RNA, 23 nt, Artificial Sequence
  source: /note="Description of Artificial Sequence: Synthetic oligonucleotide"
aauacaaaauucaacagguaaca

SEQ ID NO: 1544 - RNA, 23 nt, Artificial Sequence
  source: /note="Description of Artificial Sequence: Synthetic oligonucleotide"
auaauacaaaauucaacagguaa

SEQ ID NO: 1545 - RNA, 23 nt, Artificial Sequence
  source: /note="Description of Artificial Sequence: Synthetic oligonucleotide"
uucacugauucacauaauacaaa

SEQ ID NO: 1546 - RNA, 23 nt, Artificial Sequence
  source: /note="Description of Artificial Sequence: Synthetic oligonucleotide"
aacaucucacugauucacauaau

SEQ ID NO: 1547 - RNA, 23 nt, Artificial Sequence
  source: /note="Description of Artificial Sequence: Synthetic oligonucleotide"
aaggcuuauucuacuaacaucuc

SEQ ID NO: 1548 - RNA, 23 nt, Artificial Sequence
  source: /note="Description of Artificial Sequence: Synthetic oligonucleotide"
uaaggcuuauucuacuaacaucu

SEQ ID NO: 1549 - RNA, 23 nt, Artificial Sequence
  source: /note="Description of Artificial Sequence: Synthetic oligonucleotide"
uccaugaggaucuccauuauacg

SEQ ID NO: 1550 - RNA, 23 nt, Artificial Sequence
  source: /note="Description of Artificial Sequence: Synthetic oligonucleotide"
uuuggaauggaacucagacacca

SEQ ID NO: 1551 - RNA, 23 nt, Artificial Sequence
  source: /note="Description of Artificial Sequence: Synthetic oligonucleotide"
uacaccagggcauccacgacuuc

SEQ ID NO: 1552 - RNA, 23 nt, Artificial Sequence
  source: /note="Description of Artificial Sequence: Synthetic oligonucleotide"
uuccagguacccuugauagcaca

SEQ ID NO: 1553 - RNA, 23 nt, Artificial Sequence
  source: /note="Description of Artificial Sequence: Synthetic oligonucleotide"
uauucgggcacaaaccugggaug

SEQ ID NO: 1554 - RNA, 23 nt, Artificial Sequence
  source: /note="Description of Artificial Sequence: Synthetic oligonucleotide"
uucauucgggcacaaaccuggga

SEQ ID NO: 1555 - RNA, 23 nt, Artificial Sequence
  source: /note="Description of Artificial Sequence: Synthetic oligonucleotide"
uaucuagacacuguugcuccaga

SEQ ID NO: 1556 - RNA, 23 nt, Artificial Sequence
  source: /note="Description of Artificial Sequence: Synthetic oligonucleotide"
uuuccuagcugccuccaaaagua

SEQ ID NO: 1557 - RNA, 23 nt, Artificial Sequence
  source: /note="Description of Artificial Sequence: Synthetic oligonucleotide"
uaaacaccaaaucauugucuuug

SEQ ID NO: 1558 - RNA, 23 nt, Artificial Sequence
  source: /note="Description of Artificial Sequence: Synthetic oligonucleotide"
ucuaaacaccaaaucauugucuu

SEQ ID NO: 1559 - RNA, 23 nt, Artificial Sequence
  source: /note="Description of Artificial Sequence: Synthetic oligonucleotide"
uuucuaaacaccaaaucauuguc

SEQ ID NO: 1560 - RNA, 23 nt, Artificial Sequence
  source: /note="Description of Artificial Sequence: Synthetic oligonucleotide"
aaaguaauaaguuaucuggcagg

SEQ ID NO: 1561 - RNA, 23 nt, Artificial Sequence
  source: /note="Description of Artificial Sequence: Synthetic oligonucleotide"
auuaguaagagccaaaggugucc

SEQ ID NO: 1562 - RNA, 23 nt, Artificial Sequence
  source: /note="Description of Artificial Sequence: Synthetic oligonucleotide"
uauacaaagauuuggagccagug

SEQ ID NO: 1563 - RNA, 23 nt, Artificial Sequence
  source: /note="Description of Artificial Sequence: Synthetic oligonucleotide"
uuauacaaagauuuggagccagu

SEQ ID NO: 1564 - RNA, 23 nt, Artificial Sequence
  source: /note="Description of Artificial Sequence: Synthetic oligonucleotide"
uaugacuauacaaagauuuggag

SEQ ID NO: 1565 - RNA, 23 nt, Artificial Sequence
  source: /note="Description of Artificial Sequence: Synthetic oligonucleotide"
uagccuagacacuuugucucuag

SEQ ID NO: 1566 - RNA, 23 nt, Artificial Sequence
  source: /note="Description of Artificial Sequence: Synthetic oligonucleotide"
uucuguguagccuagacacuuug

SEQ ID NO: 1567 - RNA, 23 nt, Artificial Sequence
  source: /note="Description of Artificial Sequence: Synthetic oligonucleotide"
uaaagcaaggcagaaguuucuac

SEQ ID NO: 1568 - RNA, 23 nt, Artificial Sequence
  source: /note="Description of Artificial Sequence: Synthetic oligonucleotide"
uguguauccauucaauccuucug

SEQ ID NO: 1569 - RNA, 23 nt, Artificial Sequence
  source: /note="Description of Artificial Sequence: Synthetic oligonucleotide"
uuugguguauccauucaauccuu

SEQ ID NO: 1570 - RNA, 23 nt, Artificial Sequence
  source: /note="Description of Artificial Sequence: Synthetic oligonucleotide"
gcggcuuccugggcuucuaccac

SEQ ID NO: 1571 - RNA, 23 nt, Artificial Sequence
  source: /note="Description of Artificial Sequence: Synthetic oligonucleotide"
ucuugugcggaaggccaggaguc

SEQ ID NO: 1572 - RNA, 23 nt, Artificial Sequence
  source: /note="Description of Artificial Sequence: Synthetic oligonucleotide"
ggaaggccaggagucggaacauu

SEQ ID NO: 1573 - RNA, 23 nt, Artificial Sequence
  source: /note="Description of Artificial Sequence: Synthetic oligonucleotide"
gaaggccaggagucggaacauug

SEQ ID NO: 1574 - RNA, 23 nt, Artificial Sequence
  source: /note="Description of Artificial Sequence: Synthetic oligonucleotide"
aaaacguucuggugucugacuuu

SEQ ID NO: 1575 - RNA, 23 nt, Artificial Sequence
  source: /note="Description of Artificial Sequence: Synthetic oligonucleotide"
gucugacuuucgguccaaagacg

SEQ ID NO: 1576 - RNA, 23 nt, Artificial Sequence
  source: /note="Description of Artificial Sequence: Synthetic oligonucleotide"
uuucgguccaaagacgaagucgu

SEQ ID NO: 1577 - RNA, 23 nt, Artificial Sequence
  source: /note="Description of Artificial Sequence: Synthetic oligonucleotide"
uucgguccaaagacgaagucgug

SEQ ID NO: 1578 - RNA, 23 nt, Artificial Sequence
  source: /note="Description of Artificial Sequence: Synthetic oligonucleotide"
aagacgaagucguggaugccuug

SEQ ID NO: 1579 - RNA, 23 nt, Artificial Sequence
  source: /note="Description of Artificial Sequence: Synthetic oligonucleotide"
gccuugguauguuccugcuucau

SEQ ID NO: 1580 - RNA, 23 nt, Artificial Sequence
  source: /note="Description of Artificial Sequence: Synthetic oligonucleotide"
guggccuuaucccuccuuccuuc

SEQ ID NO: 1581 - RNA, 23 nt, Artificial Sequence
  source: /note="Description of Artificial Sequence: Synthetic oligonucleotide"
ggaggagugagugacaacguacc

SEQ ID NO: 1582 - RNA, 23 nt, Artificial Sequence
  source: /note="Description of Artificial Sequence: Synthetic oligonucleotide"
gagugagugacaacguacccuuc

SEQ ID NO: 1583 - RNA, 23 nt, Artificial Sequence
  source: /note="Description of Artificial Sequence: Synthetic oligonucleotide"
auugaugccaaaacaaccaucac

SEQ ID NO: 1584 - RNA, 23 nt, Artificial Sequence
  source: /note="Description of Artificial Sequence: Synthetic oligonucleotide"
uacgacaucugcccuaaagucaa

SEQ ID NO: 1585 - RNA, 23 nt, Artificial Sequence
  source: /note="Description of Artificial Sequence: Synthetic oligonucleotide"
ccacgaacuuucuucauguggac

SEQ ID NO: 1586 - RNA, 23 nt, Artificial Sequence
  source: /note="Description of Artificial Sequence: Synthetic oligonucleotide"
cugcacagggaaccucuaccuuc

SEQ ID NO: 1587 - RNA, 23 nt, Artificial Sequence
  source: /note="Description of Artificial Sequence: Synthetic oligonucleotide"
ggugcugggagagauaugccuuc

SEQ ID NO: 1588 - RNA, 23 nt, Artificial Sequence
  source: /note="Description of Artificial Sequence: Synthetic oligonucleotide"
gcugggagagauaugccuucgag

SEQ ID NO: 1589 - RNA, 23 nt, Artificial Sequence
  source: /note="Description of Artificial Sequence: Synthetic oligonucleotide"
ggagagauaugccuucgaggaua

SEQ ID NO: 1590 - RNA, 23 nt, Artificial Sequence
  source: /note="Description of Artificial Sequence: Synthetic oligonucleotide"
agauaugccuucgaggauauuug

SEQ ID NO: 1591 - RNA, 23 nt, Artificial Sequence
  source: /note="Description of Artificial Sequence: Synthetic oligonucleotide"
uaugccuucgaggauauuuggau

SEQ ID NO: 1592 - RNA, 23 nt, Artificial Sequence
  source: /note="Description of Artificial Sequence: Synthetic oligonucleotide"
gcauucagguucuuggaagagaa

SEQ ID NO: 1593 - RNA, 23 nt, Artificial Sequence
  source: /note="Description of Artificial Sequence: Synthetic oligonucleotide"
gucauccucagaagggauggauc

SEQ ID NO: 1594 - RNA, 23 nt, Artificial Sequence
  source: /note="Description of Artificial Sequence: Synthetic oligonucleotide"
auccugcccugggaugagagcau

SEQ ID NO: 1595 - RNA, 23 nt, Artificial Sequence
  source: /note="Description of Artificial Sequence: Synthetic oligonucleotide"
aagacaaagguggauacaugagc

SEQ ID NO: 1596 - RNA, 23 nt, Artificial Sequence
  source: /note="Description of Artificial Sequence: Synthetic oligonucleotide"
acaaagguggauacaugagcaag

SEQ ID NO: 1597 - RNA, 23 nt, Artificial Sequence
  source: /note="Description of Artificial Sequence: Synthetic oligonucleotide"
agguggauacaugagcaagauuu

SEQ ID NO: 1598 - RNA, 23 nt, Artificial Sequence
  source: /note="Description of Artificial Sequence: Synthetic oligonucleotide"
gguggauacaugagcaagauuug

SEQ ID NO: 1599 - RNA, 23 nt, Artificial Sequence
  source: /note="Description of Artificial Sequence: Synthetic oligonucleotide"
ggauacaugagcaagauuugcaa

SEQ ID NO: 1600 - RNA, 23 nt, Artificial Sequence
  source: /note="Description of Artificial Sequence: Synthetic oligonucleotide"
ugagcaagauuugcaacuugcua

SEQ ID NO: 1601 - RNA, 23 nt, Artificial Sequence
  source: /note="Description of Artificial Sequence: Synthetic oligonucleotide"
agcaagauuugcaacuugcuacc

SEQ ID NO: 1602 - RNA, 23 nt, Artificial Sequence
  source: /note="Description of Artificial Sequence: Synthetic oligonucleotide"
uuugcaacuugcuacccauuagg

SEQ ID NO: 1603 - RNA, 23 nt, Artificial Sequence
  source: /note="Description of Artificial Sequence: Synthetic oligonucleotide"
gcaacuugcuacccauuaggaua

SEQ ID NO: 1604 - RNA, 23 nt, Artificial Sequence
  source: /note="Description of Artificial Sequence: Synthetic oligonucleotide"
cugccauugcgauuguccagaga

SEQ ID NO: 1605 - RNA, 23 nt, Artificial Sequence
  source: /note="Description of Artificial Sequence: Synthetic oligonucleotide"
gcgauuguccagagacuggugac

SEQ ID NO: 1606 - RNA, 23 nt, Artificial Sequence
  source: /note="Description of Artificial Sequence: Synthetic oligonucleotide"
acuggugacauggcuuccagaua

SEQ ID NO: 1607 - RNA, 23 nt, Artificial Sequence
  source: /note="Description of Artificial Sequence: Synthetic oligonucleotide"
uuccagauaugcccgacgauguc

SEQ ID NO: 1608 - RNA, 23 nt, Artificial Sequence
  source: /note="Description of Artificial Sequence: Synthetic oligonucleotide"
cugugguugcagugggugaccuc

SEQ ID NO: 1609 - RNA, 23 nt, Artificial Sequence
  source: /note="Description of Artificial Sequence: Synthetic oligonucleotide"
ccaggucccaaaugccagugagc

SEQ ID NO: 1610 - RNA, 23 nt, Artificial Sequence
  source: /note="Description of Artificial Sequence: Synthetic oligonucleotide"
agucacuugaggaggcgagucua

SEQ ID NO: 1611 - RNA, 23 nt, Artificial Sequence
  source: /note="Description of Artificial Sequence: Synthetic oligonucleotide"
cgagucuagcagauucuuucaga

SEQ ID NO: 1612 - RNA, 23 nt, Artificial Sequence
  source: /note="Description of Artificial Sequence: Synthetic oligonucleotide"
agauucuuucagaggugcuaaag

SEQ ID NO: 1613 - RNA, 23 nt, Artificial Sequence
  source: /note="Description of Artificial Sequence: Synthetic oligonucleotide"
gauucuuucagaggugcuaaagu

SEQ ID NO: 1614 - RNA, 23 nt, Artificial Sequence
  source: /note="Description of Artificial Sequence: Synthetic oligonucleotide"
aggugcuaaaguuucccaucuuu

SEQ ID NO: 1615 - RNA, 23 nt, Artificial Sequence
  source: /note="Description of Artificial Sequence: Synthetic oligonucleotide"
uuucccaucuuugugcagcuacc

SEQ ID NO: 1616 - RNA, 23 nt, Artificial Sequence
  source: /note="Description of Artificial Sequence: Synthetic oligonucleotide"
cccugccugugacguggaggauc

SEQ ID NO: 1617 - RNA, 23 nt, Artificial Sequence
  source: /note="Description of Artificial Sequence: Synthetic oligonucleotide"
ccugugacguggaggaucccagc

SEQ ID NO: 1618 - RNA, 23 nt, Artificial Sequence
  source: /note="Description of Artificial Sequence: Synthetic oligonucleotide"
ccucugagcugaguugguuuuau

SEQ ID NO: 1619 - RNA, 23 nt, Artificial Sequence
  source: /note="Description of Artificial Sequence: Synthetic oligonucleotide"
ugaguugguuuuaugaaaagcua

SEQ ID NO: 1620 - RNA, 23 nt, Artificial Sequence
  source: /note="Description of Artificial Sequence: Synthetic oligonucleotide"
aguugguuuuaugaaaagcuagg

SEQ ID NO: 1621 - RNA, 23 nt, Artificial Sequence
  source: /note="Description of Artificial Sequence: Synthetic oligonucleotide"
uugguuuuaugaaaagcuaggaa

SEQ ID NO: 1622 - RNA, 23 nt, Artificial Sequence
  source: /note="Description of Artificial Sequence: Synthetic oligonucleotide"
ugguuuuaugaaaagcuaggaag

SEQ ID NO: 1623 - RNA, 23 nt, Artificial Sequence
  source: /note="Description of Artificial Sequence: Synthetic oligonucleotide"
gguuuuaugaaaagcuaggaagc

SEQ ID NO: 1624 - RNA, 23 nt, Artificial Sequence
  source: /note="Description of Artificial Sequence: Synthetic oligonucleotide"
uuuaugaaaagcuaggaagcaac

SEQ ID NO: 1625 - RNA, 23 nt, Artificial Sequence
  source: /note="Description of Artificial Sequence: Synthetic oligonucleotide"
ugcguuaauucagcugguuggga

SEQ ID NO: 1626 - RNA, 23 nt, Artificial Sequence
  source: /note="Description of Artificial Sequence: Synthetic oligonucleotide"
gcguuaauucagcugguugggaa

SEQ ID NO: 1627 - RNA, 23 nt, Artificial Sequence
  source: /note="Description of Artificial Sequence: Synthetic oligonucleotide"
ucagcugguugggaaaugacacc

SEQ ID NO: 1628 - RNA, 23 nt, Artificial Sequence
  source: /note="Description of Artificial Sequence: Synthetic oligonucleotide"
gcccuauuaauggucagacuguu

SEQ ID NO: 1629 - RNA, 23 nt, Artificial Sequence
  source: /note="Description of Artificial Sequence: Synthetic oligonucleotide"
cccuauuaauggucagacuguuc

SEQ ID NO: 1630 - RNA, 23 nt, Artificial Sequence
  source: /note="Description of Artificial Sequence: Synthetic oligonucleotide"
aggcuggcccaugugugaucuug

SEQ ID NO: 1631 - RNA, 23 nt, Artificial Sequence
  source: /note="Description of Artificial Sequence: Synthetic oligonucleotide"
gcuggcccaugugugaucuugug

SEQ ID NO: 1632 - RNA, 23 nt, Artificial Sequence
  source: /note="Description of Artificial Sequence: Synthetic oligonucleotide"
caccuaacuaaaauaauguuuaa

SEQ ID NO: 1633 - RNA, 23 nt, Artificial Sequence
  source: /note="Description of Artificial Sequence: Synthetic oligonucleotide"
uguuaccuguugaauuuuguauu

SEQ ID NO: 1634 - RNA, 23 nt, Artificial Sequence
  source: /note="Description of Artificial Sequence: Synthetic oligonucleotide"
uuaccuguugaauuuuguauuau

SEQ ID NO: 1635 - RNA, 23 nt, Artificial Sequence
  source: /note="Description of Artificial Sequence: Synthetic oligonucleotide"
uuuguauuaugugaaucagugag

SEQ ID NO: 1636 - RNA, 23 nt, Artificial Sequence
  source: /note="Description of Artificial Sequence: Synthetic oligonucleotide"
auuaugugaaucagugagauguu

SEQ ID NO: 1637 - RNA, 23 nt, Artificial Sequence
  source: /note="Description of Artificial Sequence: Synthetic oligonucleotide"
gagauguuaguagaauaagccuu

SEQ ID NO: 1638 - RNA, 23 nt, Artificial Sequence
  source: /note="Description of Artificial Sequence: Synthetic oligonucleotide"
agauguuaguagaauaagccuua

SEQ ID NO: 1639 - RNA, 23 nt, Artificial Sequence
  source: /note="Description of Artificial Sequence: Synthetic oligonucleotide"
cguauaauggagauccucaugga

SEQ ID NO: 1640 - RNA, 23 nt, Artificial Sequence
  source: /note="Description of Artificial Sequence: Synthetic oligonucleotide"
uggugucugaguuccauuccaaa

SEQ ID NO: 1641 - RNA, 23 nt, Artificial Sequence
  source: /note="Description of Artificial Sequence: Synthetic oligonucleotide"
gaagucguggaugcccuggugug

SEQ ID NO: 1642 - RNA, 23 nt, Artificial Sequence
  source: /note="Description of Artificial Sequence: Synthetic oligonucleotide"
ugugcuaucaaggguaccuggac

SEQ ID NO: 1643 - RNA, 23 nt, Artificial Sequence
  source: /note="Description of Artificial Sequence: Synthetic oligonucleotide"
caucccagguuugugcccgaaug

SEQ ID NO: 1644 - RNA, 23 nt, Artificial Sequence
  source: /note="Description of Artificial Sequence: Synthetic oligonucleotide"
ucccagguuugugcccgaaugac

SEQ ID NO: 1645 - RNA, 23 nt, Artificial Sequence
  source: /note="Description of Artificial Sequence: Synthetic oligonucleotide"
ucuggagcaacagugucuagaug

SEQ ID NO: 1646 - RNA, 23 nt, Artificial Sequence
  source: /note="Description of Artificial Sequence: Synthetic oligonucleotide"
uacuuuuggaggcagcuaggaag

SEQ ID NO: 1647 - RNA, 23 nt, Artificial Sequence
  source: /note="Description of Artificial Sequence: Synthetic oligonucleotide"
caaagacaaugauuugguguuua

SEQ ID NO: 1648 - RNA, 23 nt, Artificial Sequence
  source: /note="Description of Artificial Sequence: Synthetic oligonucleotide"
aagacaaugauuugguguuuaga

SEQ ID NO: 1649 - RNA, 23 nt, Artificial Sequence
  source: /note="Description of Artificial Sequence: Synthetic oligonucleotide"
gacaaugauuugguguuuagaaa

SEQ ID NO: 1650 - RNA, 23 nt, Artificial Sequence
  source: /note="Description of Artificial Sequence: Synthetic oligonucleotide"
ccugccagauaacuuauuacuuu

SEQ ID NO: 1651 - RNA, 23 nt, Artificial Sequence
  source: /note="Description of Artificial Sequence: Synthetic oligonucleotide"
ggacaccuuuggcucuuacuaau

SEQ ID NO: 1652 - RNA, 23 nt, Artificial Sequence
  source: /note="Description of Artificial Sequence: Synthetic oligonucleotide"
cacuggcuccaaaucuuuguaua

SEQ ID NO: 1653 - RNA, 23 nt, Artificial Sequence
  source: /note="Description of Artificial Sequence: Synthetic oligonucleotide"
acuggcuccaaaucuuuguauag

SEQ ID NO: 1654 - RNA, 23 nt, Artificial Sequence
  source: /note="Description of Artificial Sequence: Synthetic oligonucleotide"
cuccaaaucuuuguauagucauc

SEQ ID NO: 1655 - RNA, 23 nt, Artificial Sequence
  source: /note="Description of Artificial Sequence: Synthetic oligonucleotide"
cuagagacaaagugucuaggcua

SEQ ID NO: 1656 - RNA, 23 nt, Artificial Sequence
  source: /note="Description of Artificial Sequence: Synthetic oligonucleotide"
caaagugucuaggcuacacagaa

SEQ ID NO: 1657 - RNA, 23 nt, Artificial Sequence
  source: /note="Description of Artificial Sequence: Synthetic oligonucleotide"
guagaaacuucugccuugcuuug

SEQ ID NO: 1658 - RNA, 23 nt, Artificial Sequence
  source: /note="Description of Artificial Sequence: Synthetic oligonucleotide"
cagaaggauugaauggauacacc

SEQ ID NO: 1659 - RNA, 23 nt, Artificial Sequence
  source: /note="Description of Artificial Sequence: Synthetic oligonucleotide"
aaggauugaauggauacaccaaa

We claim:

1. A double stranded ribonucleic acid (dsRNA) agent for inhibiting expression of Patatin-Like Phospholipase Domain Containing 3 (PNPLA3), wherein said dsRNA agent comprises a sense strand and an antisense strand forming a double stranded region, the antisense strand comprising a region of complementarity to an mRNA encoding PNPLA3, wherein the region of complementarity comprises at least 15 contiguous nucleotides differing by no more than 3 nucleotides from the nucleotide sequence 5'-UAAGGAAGGAGGGAUAAGGCCAC-3' (SEQ ID NO:1310), wherein substantially all of the nucleotides of said sense strand and substantially all of the nucleotides of said antisense strand are modified nucleotides, and
    wherein said dsRNA agent is conjugated to a ligand.

2. The dsRNA agent of claim 1, wherein all of the nucleotide of the sense strand and all of the nucleotides of the antisense strand are modified nucleotides.

3. The dsRNA agent of claim 1, wherein the modified nucleotides are selected from the group consisting of a deoxy-nucleotide, a 3'-terminal deoxy-thymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxly-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, and a nucleotide comprising a 5'-phosphate mimic.

4. The dsRNA agent of claim 1, wherein the region of complementarity is at least 17 nucleotides in length; between 19 and 21 nucleotides in length; or 19 nucleotides in length.

5. The dsRNA agent of claim 1, wherein each strand is no more than 30 nucleotides in length.

6. The dsRNA agent of claim 1, wherein at least one strand comprises a 3' overhang of at least 1 nucleotide; or at least 2 nucleotides.

7. The dsRNA agent of claim 1, wherein the ligand is attached at the 3'-terminus of the sense strand.

8. A double stranded ribonucleic acid (dsRNA) agent for inhibiting the expression of PNPLA3, wherein said dsRNA agent comprises a sense strand complementary to an antisense strand, wherein said antisense strand comprises a region of complementarity to an mRNA encoding PNPLA3, wherein the region of complementarity comprises at least 15 contiguous nucleotides differing by no more than 3 nucleotides from the nucleotide sequence 5'-UAAGGAAGGAGGGAUAAGGCCAC-3' (SEQ ID NO:1310), wherein each strand is about 14 to about 30 nucleotides in length, wherein said dsRNA agent is represented by formula (III):

```
                                                              (III)
sense:
5'  n_p-N_a-(X X X)_i-N_b-Y Y Y-N_b-(Z Z Z)_j-N_a-n_q  3' antisense:
3'  n_p'-N_a'-(X'X'X')_k-N_b'-Y'Y'Y'-N_b'-(Z'Z'Z')_l-N_a'-
n_q'  5'
``` wherein:
i, j, k, and l are each independently 0 or 1;
p, p', q, and q' are each independently 0-6;
each $N_a$ and $N_a'$ independently represents an oligonucleotide sequence comprising 0-25 nucleotides which are either modified or unmodified or combinations thereof, each sequence comprising at least two differently modified nucleotides;
each $N_b$ and $N_b'$ independently represents an oligonucleotide sequence comprising 0-10 nucleotides which are either modified or unmodified or combinations thereof;
each $n_p$, $n_p'$, $n_q$, and $n_q'$, each of which may or may not be present, independently represents an overhang nucleotide;
XXX, YYY, ZZZ, X'X'X', Y'Y'Y', and Z'Z'Z' each independently represent one motif of three identical modifications on three consecutive nucleotides; and wherein the sense strand is conjugated to at least one ligand.

9. The dsRNA agent of claim 8, wherein formula (III) is represented by a formula selected from the group consisting of
formula (IIIa):

```
formula (IIIa):                                           (IIIa)
sense:
5'  n_p-N_a-Y Y Y-N_a-n_q  3' antisense:
3'  n_p'-N_a'-Y'Y'Y'-N_a'-n_q'  5';

formula (IIIb):                                           (IIIb)
sense:
5'  n_p-N_a-Y Y Y-N_b-Z Z Z-N_a-n_q  3' antisense:
3'  n_p'-N_a'-Y'Y'Y'-N_b'-Z'Z'Z'-N_a'-n_q'  5' formula (IIIc):                                           (IIIc)
sense:
5'  n_p-N_a-X X X-N_b-Y Y Y-N_a-n_q  3' antisense:
3'  n_p'-N_a'-X'X'X'-N_b'-Y'Y'Y'-N_a'-n_q'  5' formula (IIId):                                           (IIId)
sense:
5'  n_p-N_a-X X X-N_b-Y Y Y-N_b-Z Z Z-N_a-n_q  3' antisense:
3'  n_p'-N_a'-X'X'X'-N_b'-Y'Y'Y'-N_b'-Z'Z'Z'-N_a'-n_q'  5'
``` wherein each $N_b$ and $N_b'$ independently represents an oligonucleotide sequence comprising 1-5 modified nucleotides and each $N_a$ and $N_a'$ independently represents an oligonucleotide sequence comprising 2-10 modified nucleotides.

10. The dsRNA agent of claim 1 or 8, wherein the ligand is one or more GalNAc derivatives attached through a bivalent or trivalent branched linker.

11. The dsRNA agent of claim 10, wherein the ligand is

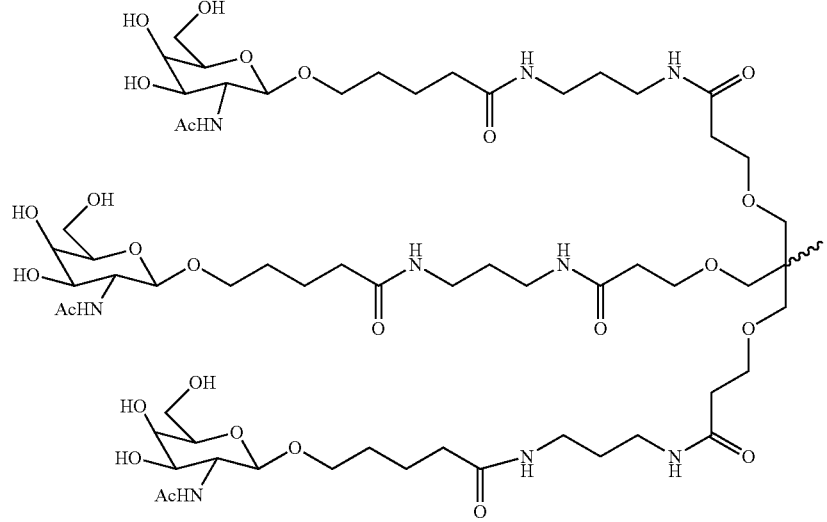

12. The dsRNA agent of claim 1 or 8, wherein said dsRNA agent further comprises at least one phosphorothioate or methylphosphonate internucleotide linkage.

13. A cell containing the dsRNA agent of claim 1.

14. A pharmaceutical composition for inhibiting expression of a PNPLA3 gene comprising the dsRNA agent of claim 1.

15. A method of inhibiting PNPLA3 expression in a cell, the method comprising:
   (a) contacting the cell with the dsRNA agent of claim 1 or a pharmaceutical composition of claim 14; and
   (b) maintaining the cell produced in step (a) for a time sufficient to obtain degradation of the mRNA transcript of a PNPLA3 gene, thereby inhibiting expression of the PNPLA3 gene in the cell.

16. The method of claim 15, wherein said cell is within a subject.

17. The method of claim 16, wherein the subject is a human.

18. A method of treating a subject having a disease or disorder that would benefit from reduction in PNPLA3 expression, the method comprising administering to the subject a therapeutically effective amount of the dsRNA agent of claim 1 or a pharmaceutical composition of claim 14, thereby treating said subject.

19. A method of preventing at least one symptom in a subject having a disease or disorder that would benefit from reduction in PNPLA3 expression, the method comprising administering to the subject a prophylactically effective amount of the dsRNA agent of claim 1 or a pharmaceutical composition of claim 14, thereby preventing at least one symptom in the subject having a disorder that would benefit from reduction in PNPLA3 expression.

20. The method of claim 18 or 19, wherein the disorder is a PNPLA3-associated disease.

21. The method of claim 18 or 19, further comprising administering an anti-PNPLA3 antibody, or antigen-binding fragment thereof, to the subject.

22. The method of claim 20, wherein the PNPLA3-associate disorder is fatty liver (steatosis), nonalcoholic steatohepatitis (NASH), cirrhosis of the liver, accumulation of fat in the liver, inflammation of the liver, hepatocellular necrosis, liver fibrosis, obesity, or nonalcoholic fatty liver disease (NAFLD).

23. The dsRNA agent of claim 1 or 8, wherein each of the sense strand and the antisense strand independently is 21 to 23 nucleotides in length.

24. The dsRNA agent claim 1 or 8, wherein the sense strand is 21 nucleotides in length and the antisense strand is 23 nucleotides in length.

25. The dsRNA agent of claim 1 or 8, wherein the region of complementarity comprises the nucleotide sequence of 5'-UAAGGAAGGAGGGAUAAGGCCAC-3' (SEQ ID NO:1310).

26. The dsRNA agent of claim 25, wherein the sense strand comprises the nucleotide sequence 5'-GGCCUUAUCCCUCCUUCCUUA-3' (SEQ ID NO:1220) and the antisense strand comprises the nucleotide sequence 5'-UAAGGAAGGAGGGAUAAGGCCAC-3' (SEQ ID NO:1310).

27. The dsRNA agent of claim 26, wherein the sense strand comprises the nucleotide sequence 5'-gsgsccuuAfuCfCfCfuccuuccuua-3' (SEQ ID NO: 1400) and the antisense strand comprises the nucleotide sequence 5'-usAfsaggAfaGfGfagggAfuAfaggccsasc-3' (SEQ ID NO: 1490),
   wherein a, g, c, and u are 2'-O-methyl (2'-OMe) A, G, C and U; Af, Gf, Cf and Uf are 2' fluoro A, G, C and U; and s is a phosphorothioate linkage.

28. The dsRNA agent of claim 26, wherein the dsRNA agent comprises
   a sense strand consisting of the nucleotide sequence 5'-gsgsccuuAfuCfCfCfuccuuccuuaL96-3' (SEQ ID NO: 1400) and an antisense strand consisting of the nucleotide sequence 5'-usAfsaggAfaGfGfagggAfuAfaggccsasc-3' (SEQ ID NO: 1490),
   wherein a, g, c, and u are 2'-O-methyl (2'-OMe) A, G, C and U; Af, Gf, Cf and Uf are 2' fluoro A, G, C and U; s is a phosphorothioate linkage; and L96 is N-[tris(GalNAc-alkyl)-amidodecanoyl)]-4-hydroxyprolinol.

* * * * *